US012630598B2

(12) United States Patent
Hsu et al.

(10) Patent No.: US 12,630,598 B2
(45) Date of Patent: May 19, 2026

(54) IL-10 MUTEINS AND FUSION PROTEINS THEREOF

(71) Applicant: AMGEN INC., Thousand Oaks, CA (US)

(72) Inventors: Hailing Hsu, Thousand Oaks, CA (US); Ian Foltz, Thousand Oaks, CA (US); Marissa Mock, Thousand Oaks, CA (US); Victor Mitch Luna, Thousand Oaks, CA (US); Ming Zhang, Thousand Oaks, CA (US); Sharon Lynn Wannberg, Thousand Oaks, CA (US); Gamze Ozlem Camdere Tapia, Thousand Oaks, CA (US); Timothy Patrick Riley, Thousand Oaks, CA (US)

(73) Assignee: AMGEN INC., Thousand Oaks, CA (US)

( * ) Notice: Subject to any disclaimer, the term of this patent is extended or adjusted under 35 U.S.C. 154(b) by 484 days.

(21) Appl. No.: 18/001,913

(22) PCT Filed: Jun. 25, 2021

(86) PCT No.: PCT/US2021/039191
§ 371 (c)(1),
(2) Date: Dec. 15, 2022

(87) PCT Pub. No.: WO2021/263167
PCT Pub. Date: Dec. 30, 2021

(65) Prior Publication Data
US 2023/0265145 A1 Aug. 24, 2023

Related U.S. Application Data

(60) Provisional application No. 63/199,218, filed on Dec. 14, 2020, provisional application No. 63/045,041, filed on Jun. 26, 2020.

(51) Int. Cl.
| | |
|---|---|
| *A61K 38/20* | (2006.01) |
| *C07K 14/54* | (2006.01) |
| *C07K 16/28* | (2006.01) |
| *A61K 38/00* | (2006.01) |

(52) U.S. Cl.
CPC ...... *C07K 14/5428* (2013.01); *C07K 16/2803* (2013.01); *A61K 38/00* (2013.01); *C07K 2317/21* (2013.01); *C07K 2317/33* (2013.01); *C07K 2317/56* (2013.01); *C07K 2317/76* (2013.01); *C07K 2317/92* (2013.01); *C07K 2319/00* (2013.01)

(58) Field of Classification Search
None
See application file for complete search history.

(56) References Cited

U.S. PATENT DOCUMENTS

| | | |
|---|---|---|
| 2008/0260820 A1 | 10/2008 | Borrelly et al. |
| 2009/0035256 A1 | 2/2009 | Sommer et al. |
| 2013/0211050 A1 | 8/2013 | Stennicke et al. |
| 2013/0309239 A1 | 11/2013 | Stennicke et al. |
| 2015/0218244 A1 | 8/2015 | Emrich et al. |
| 2016/0068583 A1 | 3/2016 | Van Vlasselaer et al. |
| 2016/0235816 A1 | 8/2016 | Chavez et al. |
| 2016/0251434 A1 | 9/2016 | Colonna |
| 2017/0158747 A1 | 6/2017 | Didonato et al. |
| 2017/0298130 A1 | 10/2017 | Henriksen et al. |
| 2019/0300608 A1 | 10/2019 | Pashine et al. |
| 2019/0315883 A1 | 10/2019 | Ast et al. |
| 2020/0131264 A1 | 4/2020 | Pincetic et al. |

FOREIGN PATENT DOCUMENTS

| | | |
|---|---|---|
| CN | 108503713 A | 9/2018 |
| WO | 0027881 | 5/2000 |
| WO | 2001058950 | 8/2001 |
| WO | 2004/044006 A1 | 5/2004 |
| WO | 2014023673 | 2/2014 |
| WO | 2014176373 | 10/2014 |
| WO | 2015117930 A1 | 8/2015 |
| WO | 2017093947 | 6/2017 |
| WO | 2017152102 A2 | 9/2017 |
| WO | 2020082057 | 4/2023 |

OTHER PUBLICATIONS

Bosco Maria Carla et al, "Therapeutic Potential of Targeting TREM-1 in Inflammatory Diseases and Cancer", vol. 22, No. 41, 2016.
Erdman "Host Inflammatory Pathways in Malaria Infection: Potential Therapeutic Targets and Biomarkers of Disease Severity", Graduate Department of Institute of Medical Science, (Nov. 1, 2022).
International Search Report, PCT/US2021/039191, 7 pages, Mar. 23, 2022.
Van Der Linde K et al, "A functional interleukin-10 mutation in Dutch patients with Crohn's disease", Digestive and Liver Disease, W.B. Saunders, GB, vol. 37, No. 5, May 1, 2005 (May 1, 2005), p. 330-335.
Zdanov Alexander, "Structural Features of the Interleukin-10 Family of Cytokines", NL, (Dec. 1, 2004), vol. 10, No. 31, p. 3873-3884.
Altshuler et al., Generation of recombinant antibodies and means for increasing their affinity, Journal of Biological Chemistry, 2010, v.50, p. 207.
Official Action, Eurasian Patent Office Application No. 202390159, May 15, 2024.
Eurasian Office Action, Application No. 202390159, (p. 13) Dec. 8, 2023.

(Continued)

*Primary Examiner* — Fred H Reynolds
(74) *Attorney, Agent, or Firm* — Melissa E. Karabinis

(57) ABSTRACT

The present disclosure relates, in general, to muteins of IL-10 that are stable as monomers, antigen binding proteins that bind to TREM-1, and antigen binding proteins comprising IL-10 muteins and antigen binding moieties, e.g., anti-TREM-1 antibodies, and compositions thereof. The disclosure also provides methods of treating inflammatory disease, such as inflammatory bowel disease or ulcerative colitis, using the compositions.

6 Claims, 12 Drawing Sheets

Specification includes a Sequence Listing.

(56) References Cited

OTHER PUBLICATIONS

International Preliminary Report on Patentability and Written Opinion issued to International Application No. PCT/US2021/039191, issued Dec. 13, 2022.

Gorby, et al: "Engineered IL-10 variants elicit potent immunomodulatory effects at low ligand doses". Sci Signal. Sep. 15, 2020; 13(649): eabc0653. Published online Sep. 15, 2020. doi: 10.1126/scisignal. abc0653.

Interleukin 10 [Brachylagus idahoensis] GenBank: ALG04625.1. Apr. 10, 2015. Link: https://www.ncbi.nlm.nih.gov/protein/ALG04625. 1?report=genbank&log$=protalign&blast_rank=43&RID= 4RGJBBB6013, 2015.

Search Report issued to Chilean Patent Application No. 202203755, dated May 27, 2024.

Sung Il Yoon, et al: "Epstein-Barr virus IL-10 engages IL-10R1 by a two-step mechanism leading to altered signaling properties". J Biol Chem. Aug. 3, 2012;287(32):26586-95. doi: 10.1074/jbc.M112. 376707. Epub Jun. 12, 2012.

Sung Il Yoon, et al: "Same structure, different function crystal structure of the Epstein-Barr virus IL-10 bound to the soluble IL-10R1 chain". Structure. Apr. 2005;13(4):551-64. doi: 10.1016/ j.str.2005.01.016.

Josephson, Kristopher, et al., Design and Analysis of an Engineered Human Interleukin-10 Monomer, "The Journal of Biological Chemistry", vol. 275, No. 18, pp. 13552-13557, 2000.

Koiko R., Immunology: study guide, Moscow, the Academy Publishing House, 2008, pp. 61-62, English Translation.

UniProt20 Feb. 2014 (Feb. 20, 2014), retrieved from EBI accession No. UNIPROT:A0A619IZI6Database accession No. A0A619IZI6. "RecName: Full=Cytokine synthesis inhibitory factor {ECO:0000256|ARBA:ARBA00014947}; AllName: Full=Interleukin-10 {ECO:0000256|ARBA:ARBA00016754};", Oct. 7, 2020.

Walter et al., "Crystal structure of interleukin 10 reveals an interferon gamma-like fold", Biochemistry, vol. 34(38), p. 12118-12125(1995).

Zdanov et al., "Crystal structure of human interleukin-10 at 1.6 Å resolution and a model of a complex with its soluble receptor", Protein Science, vol. 5(10), pp. 1955-1962(1996).

Zdanov et al., "Crystal structure of interleukin-10 reveals the functional dimer with an unexpected topological similarity to interferon ?", Structure, vol. 3(6), pp. 591-601(1995).

Walter, "The molecular basis of IL-10 function: from receptor structure to the onset of signaling", Curr Top Microbiol Immunol., vol. 380, pp. 191-212(2014).

TREM-1 /IL-10 mutein

TREM-1 mono/IL-10 mutein

Figure 1D
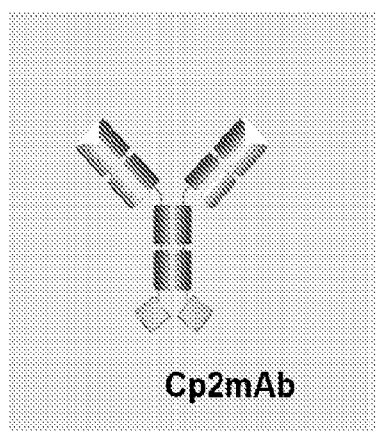
Cp2mAb
C terminal
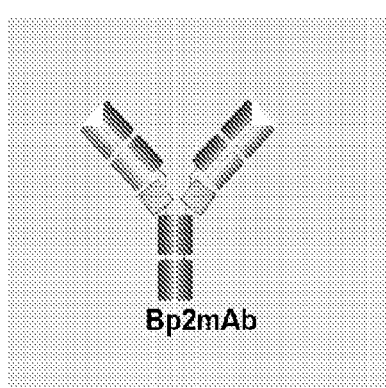
Bp2mAb
Buried- Fab-G4-IL-10 G4-Fc
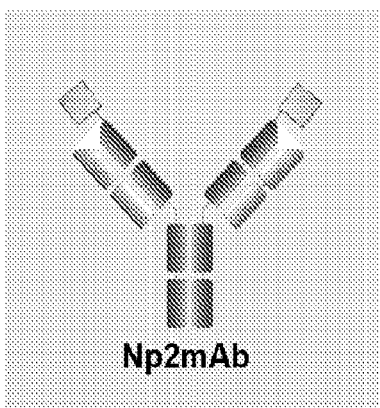
Np2mAb
N terminal Figure 5A. Human Monocytes
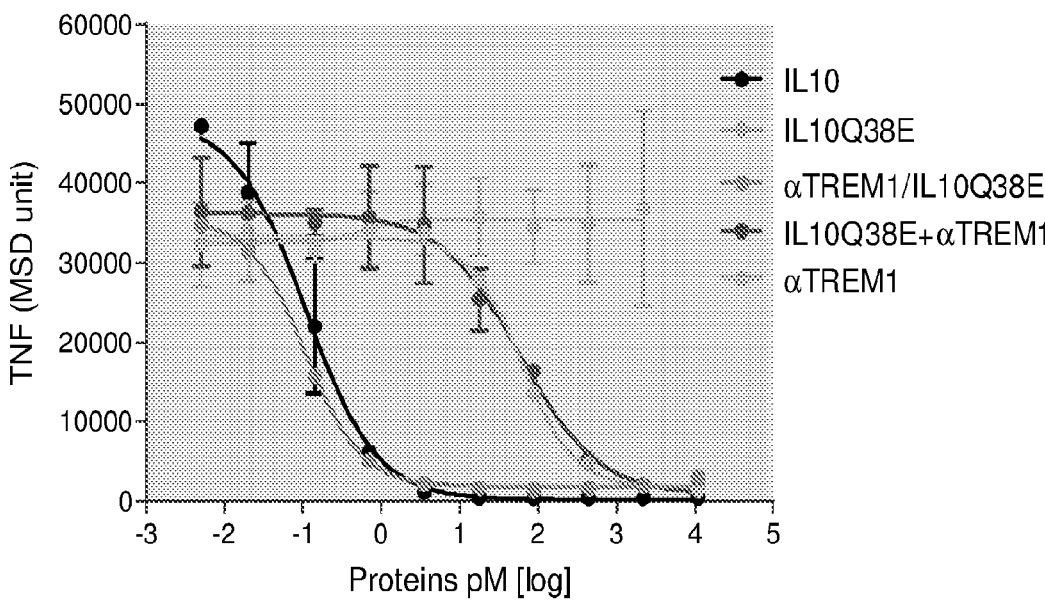
Figure 5B. Mouse Monocytes
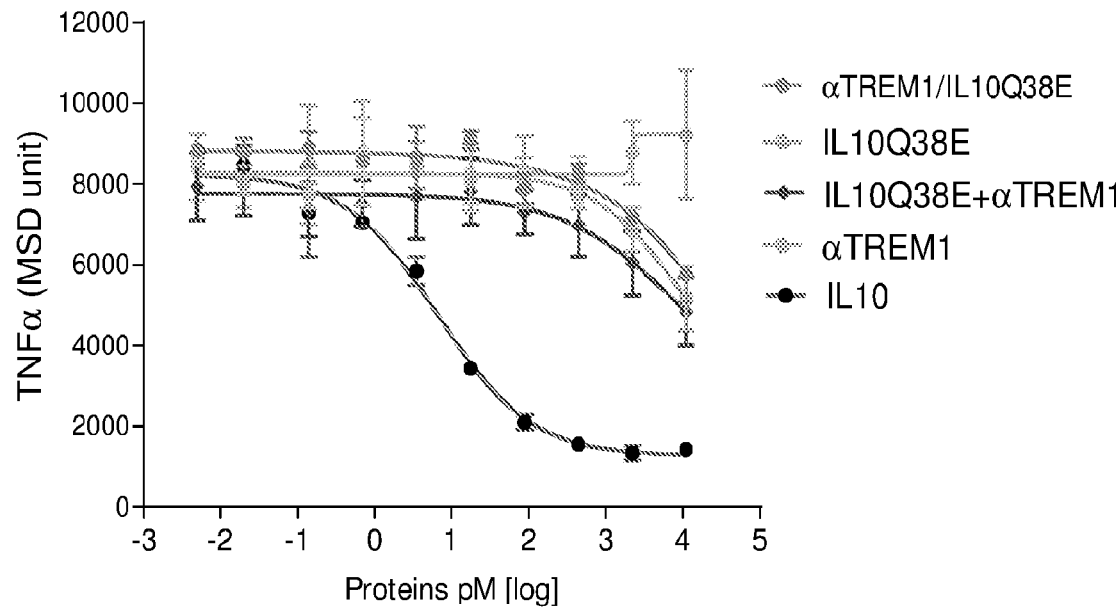

Cyno PBMCs

64D7 AB

Human PBMCs

61B12 AB

IL-10 MUTEINS AND FUSION PROTEINS THEREOF

CROSS REFERENCE TO RELATED APPLICATIONS

This application is a National Stage application under 35 U.S.C. § 371 of International Application No. PCT/US21/39191, having an international filing date of Jun. 25, 2021, which claims the benefit of U.S. Provisional Application No. 63/045,041, filed Jun. 26, 2020, and U.S. Provisional Application No. 63/199,218, filed Dec. 14, 2020, each of which is herein incorporated by reference in its entirety.

FIELD OF THE DISCLOSURE

The present disclosure relates to muteins of interleukin-10 and antigen binding proteins comprising IL-10 and antigen binding moieties, such as anti-TREM-1 or anti-PD-1 antibodies, for the treatment of inflammatory conditions, such as inflammatory bowel disease.

REFERENCE TO SEQUENCE LISTING SUBMITTED ELECTRONICALLY VIA PATENT CENTER

The Sequence Listing, which is a part of the present disclosure, is submitted concurrently with the specification as a zip file. The name of the text file containing the Sequence Listing is "A-2390-US03-PCT Sequence Listing", which was created on Dec. 12, 2022 and is 4,894 kilobytes in size. The subject matter of the Sequence Listing is incorporated herein in its entirety by reference.

BACKGROUND OF THE DISCLOSURE

Interleukin-10 (IL-10) is an important cytokine that is involved in a variety of immunoregulation processes (see Ouyang and O'Garra, *Immunity*, 50(4):871-891 2019). In particular, it has either immunosuppressive or immunostimulatory effects depending on the immune system cell type. IL-10 suppresses upregulation of inflammatory cytokines, MHCII, CD86 and ICAM in monocytes and tissue macrophages. IL-10 is also reported to enhance Treg cell suppression activity. However, IL-10 also stimulates CD8+ T cell activation and B cell activation. There is strong genetic association of IL-10 with inflammatory bowel disease (IBD). Patients with IL-10, IL-10R1, or IL-10R2 homozygous loss of function mutations developed severe infantile IBD (Kotlarz, *Gastroenterology*, 2012; Glocker, *NEM*, 2009). IL10 rs3024505 is also reported associated with IBD in the GWAS, with RAF 0.16, OR 1.46, p value $10^{-42}$ (Jostins L, 2012). A PEGylated IL-10 showed modest efficacy in a Crohn's Disease study likely due to dose-limiting toxicity (Schreiber et al., *Gastroenterology* 119: 1461, 2000). A previous study using mice having an IL-10R1 knockout in myeloid cells showed that anti-inflammatory activity of IL-10 on myeloid cells is important for controlling colitis development (Zigmond et al., *Immunity*, 40(5):720-33, 2014).

SUMMARY OF THE DISCLOSURE

The present disclosure provides muteins of IL-10 that are stable as monomers and are useful in the treatment of inflammatory diseases. It is contemplated that the IL-10 muteins retain/restore IL-10 suppression activity on monocytes and macrophages, and reduce IL-10 stimulation of CD8+ T cells and B cells. The disclosure also provides antibodies to TREM-1 that are useful in the treatment of inflammatory diseases. In a further aspect, the disclosure provides antigen binding proteins comprising IL-10 muteins and antigen binding moieties, such as anti-TREM-1 or anti-PD-1 antibodies, useful to treat inflammatory diseases.

Provided herein is a human interleukin-10 (IL-10) mutein comprising an amino acid sequence that is at least 90% identical to the amino acid sequence set forth in SEQ ID NO: 2, wherein said IL-10 mutein has at least one mutation selected from a mutation in helical loop AB, helical loop CD, helical loop DE, helix A, helix B, helix C, helix D, helix E and/or helix F. In various embodiments, the IL-10 mutein of the disclosure comprises at least one mutation in helix A, helix F or helical loop AB. In various embodiments, the IL-10 mutein is at least 95% identical to the amino acid sequence set forth in SEQ ID NO: 2. In various embodiments, the IL-10 mutein amino acid sequence is 96%, 97%, 98% or 99% identical to the amino acid sequence set out in SEQ ID NO: 2.

In various embodiments, the IL-10 mutein comprises a mutation in one or more of residues N10, H14, F15, P20, M22, L23, R24, R27, D28, K34, T35, Q38, M39, K40, D41, Q42, L43, D44, N45, L46, L47, L48, K49, F56, K57, Y59, L60, Q63, E67, Q70, M77, Q79, N82, Q83, D84, P85, D86, I87, A89, H90, S93, T100, L103, H109, R110, L112, E115, N116, A127, K130, I136, Y137, K138, S141, E142, D144, I145, E151, M154, M156, K157, or N160 of SEQ ID NO: 2 and/or an addition of 4 to 8 amino acids between helix D and helix E. In various embodiments, the mutation is R27L, K34D, D41G, L46K, Q38E, Q38R, Q38D, K138L, K138D, or I87A of SEQ ID NO: 2, optionally comprising addition of 6 amino acids between helix D and helix E. In various embodiments, the mutation is N10Q, N10I, N10K, R27L, K34D, D41G, L46K, Q38E, Q38R, Q38D, K138L, K138D, I87A, H14Q, F15Y, M22V, K49T, K49S, F56Y, K57N, Y59T, L60Q, Q63E, Q63L, E67C, Q70E, Q70K, M77R, M77V, Q79R, Q79C, D84R, A89P, H90E, H90Q, S93E, S93Q, T100R, L103E, H109D, R110P, R110Q, L112V, E115K, N116D, N116Q, A127M, K130Q, I136C, Y137C, M154V, M156C, K157N, or N160D of SEQ ID NO: 2, optionally comprising addition of 4 to 8 amino acids between helix D and helix E. In various embodiments, the I10 mutein encompasses combinations of I10 mutations as set out in Table 16 or Table 17 or Table 21, and the disclosure herein. In various embodiments, the amino acids between helix D and helix E are GGGSGG (SEQ ID NO: 2676). In various embodiments, the amino acid sequence of certain IL-10 muteins is set out in SEQ ID NOS: 3-10, and SEQ ID NOS: 2138, 2140, 2142, 2144, 2146, 2148, 2150, 2152, 2154, 2156, 2158, 2160, 2162, 2164, 2166, 2168, 2170 2172, 2174, 2176, 2178, 2180, 2182, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2500, 2502, 2504, 2506, 2508, 2510, 2512, 2514, 2516, 2518, 2520, 2522, 2524, 2526, 2528, 2530, 2532, 2534, 2536, 2540, and 2777-2791.

In various embodiments, the disclosure provides a human interleukin-10 (IL-10) mutein comprising an amino acid sequence that is at least 90% identical to the amino acid sequence set forth in SEQ ID NOs: 3-10 or SEQ ID NOS:

2138, 2140, 2142, 2144, 2146, 2148, 2150, 2152, 2154, 2156, 2158, 2160, 2162, 2164, 2166, 2168, 2170 2172, 2174, 2176, 2178, 2180, 2182, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2500, 2502, 2504, 2506, 2508, 2510, 2512, 2514, 2516, 2518, 2520, 2522, 2524, 2526, 2528, 2530, 2532, 2534, 2536, 2538, or 2540 and 2777-2791. In various embodiments, the mutein comprises an amino acid sequence that is at least 95%, 96%, 97%, 98%, or 99% identical to the mutein sequences described herein.

In various embodiments, the IL-10 mutein reduces the suppression of TNF-α production in myeloid cells, reduces levels of CD8+ T cell stimulation, and/or reduces the level of B cell stimulation compared to wild type (wt) IL-10. In various embodiments, the anti-TREM-1/IL-10 mutein antigen binding protein suppresses TNF-α production in myeloid cells. In various embodiments, the anti-TREM-1/IL-10 mutein antigen binding protein suppresses TNF-α production in myeloid cells, while reducing CD8+ T cell and B cell activation.

In various embodiments, the IL-10 mutein is fused to a binding moiety that targets the antigen binding protein to myeloid cells, B cells, or T cells. In various embodiments, the binding protein binds to a cell surface protein on a myeloid cell, CD8+ T cell, CD4+ T cell, or B cell.

In various embodiments, the IL-10 mutein further comprises a half-life extending moiety. In various embodiments, the half-life extending moiety is an Fc domain. In various embodiments, the half-life extending moiety is polyethylene glycol (PEG) or the like.

In various embodiments, the mutein is a dimer. In various embodiments the mutein dimer comprises two different mutein monomers. In various embodiments, the mutein dimer comprises the same mutein monomers.

Further provided is an isolated nucleic acid molecule comprising a nucleotide sequence that encodes the IL-10 mutein as described herein. In various embodiments, the polynucleotide sequence of the IL-10 muteins is set out in SEQ ID NO: 11-18.

The disclosure also contemplates an expression vector comprising a nucleic acid molecule comprising a nucleotide sequence that encodes the IL-10 mutein operably linked to an expression control sequence.

Provided herein is a recombinant host cell comprising the nucleic acid or vector comprising a nucleotide sequence that encodes the IL-10 mutein. In various embodiments, the host cell is a mammalian cell. In various embodiments, the host cell is a CHO cell. Also provided is a method of using the host cell to produce an IL-10 mutein, comprising culturing the host cell and recovering the IL-10 mutein, and an IL-10 mutein produced by the method.

The disclosure also provides a pharmaceutical composition comprising the IL-10 mutein as described herein and a pharmaceutically acceptable carrier. It is contemplated that the pharmaceutical composition can be a sterile pharmaceutical composition.

In another aspect, the disclosure provides an isolated antigen binding protein, wherein the antigen binding protein:

a. is an antibody or antibody fragment;

b. binds to human TrigGering Receptor Expressed on Myeloid cells 1 (TREM-1) having the amino acid sequence set forth in SEQ ID NO: 20;

c. comprises a light chain variable domain comprising:
  i. a light chain CDR1 comprising an amino acid sequence selected from SEQ ID NOS: 30, 50, 70, 90, 110, 130, 150, 170, 190, 210, 230, 250, 270, 290 and 2190;
  ii. a light chain CDR2 comprising an amino acid sequence selected from SEQ ID NOS: 31, 51, 71, 91, 111, 131, 151, 171, 191, 211, 231, 251, 271, 291 and 2191;
  iii. a light chain CDR3 comprising an amino acid sequence selected from SEQ ID NOS: 32, 52, 72, 92, 112, 132, 152, 172, 192, 212, 232, 252, 272, 292 and 2192; and d. comprises a heavy chain variable domain comprising:
  i. a heavy chain CDR1 comprising an amino acid sequence selected from SEQ ID NOS: 36, 56, 76, 96, 116, 136, 156, 176, 196, 216, 236, 256, 276, 296 and 2196;
  ii. a heavy chain CDR2 comprising an amino acid sequence selected from SEQ ID NOS: 37, 57, 77, 97, 117, 137, 157, 177, 197, 217, 237, 257, 277, 297 and 2197; and
  iii. a heavy chain CDR3 comprising an amino acid sequence selected from SEQ ID NOS: 38, 58, 78, 98, 118, 138, 158, 178, 198, 218, 238, 258, 278, 298 and 2198.

In various embodiments,
a. the light chain CDR1 sequence is set out in SEQ ID NO: 30, 50, 70, 110, 150, 170, or 290;
b. the light chain CDR2 sequence is set out in SEQ ID NO: 31, 51, 71, 111, 151, 171, or 291;
c. the light chain CDR3 sequence is set out in SEQ ID NO: 32, 52, 72, 112, 152, 172, or 292
d. the heavy chain CDR1 sequence is set out in SEQ ID NO: 36, 56, 76, 116, 156, 176, or 296;
e. the heavy chain CDR2 sequence is set out in SEQ ID NO: 37, 57, 77, 117, 157, 177, or 297; and
f. the heavy chain CDR3 sequence is set out in SEQ ID NO: 38, 58, 78, 118, 158, 178, or 298.

In various embodiments,
a. the light chain CDR1 sequence is set out in SEQ ID NO: 50 or 110;
b. the light chain CDR2 sequence is set out in SEQ ID NO: 51 or 111;
c. the light chain CDR3 sequence is set out in SEQ ID NO: 52 or 112;
d. the heavy chain CDR1 sequence is set out in SEQ ID NO: 56 or 116;
e. the heavy chain CDR2 sequence is set out in SEQ ID NO: 57 or 117; and
f. the heavy chain CDR3 sequence is set out in SEQ ID NOS: 58 or 118.

Also contemplated are consensus sequences of the TREM-1 antibody heavy and light chain CDRs and/or variable region sequences disclosed herein. For example, in various embodiments, the TREM-1 antibody comprises an antigen binding domain comprising a sequence having a light chain variable region comprising a LCDR1 amino acid sequence selected from the group consisting of:

$X_1$ASQSX$_2$X$_3$X$_4$NLA (SEQ ID NO: 2199), wherein X$_1$ is R or Q, wherein X$_2$ is V or I, wherein X$_3$ is N or S, and wherein X$_4$ is S, H, I, V or A;

QASX$_1$DIX$_2$X$_3$X$_4$LN (SEQ ID NO: 2204), wherein X$_1$ is R or Q, wherein X$_2$ is R, S, N or F, wherein X$_3$ is K or N, and wherein X$_4$ is H, Y or D;

RASQSVNSNLA (SEQ ID NO: 2212);

QASQDIRKHLN (SEQ ID NO: 2213);

RASQDISSNLN (SEQ ID NO: 2214);

QASQDIHLN (SEQ ID NO: 2215);

RASQGIRKWLA (SEQ ID NO:2216)

RASQSVNSNLA (SEQ ID NO: 2217) and

SGDKLGERVS (SEQ ID NO: 2218).

In various embodiments, the TREM-1 antibody comprises an antigen binding domain comprising a sequence having a light chain variable region comprising a LCDR2 amino acid sequence selected from the group consisting of:

GAX$_1$X$_2$RAT (SEQ ID NO: 2200), wherein X$_1$ is S or Y, and wherein X$_2$ is T or I;

X$_1$X$_2$X$_3$X$_4$LET (SEQ ID NO: 2206), wherein X$_1$ is D, G or H, wherein X$_2$ is A, V or T, wherein X$_3$ is S, A or Y, and wherein X$_4$ is T or N;

GASTRAT (SEQ ID NO: 2219);

DASNLET (SEQ ID NO: 2220); and

AASRLQS (SEQ ID NO: 2221).

In various embodiments, the TREM-1 antibody comprises an antigen binding domain comprising a sequence having a light chain variable region comprising a LCDR3 amino acid sequence selected from the group consisting of QX$_1$X$_2$X$_3$X$_4$X$_5$X$_6$PX$_7$T (SEQ ID NO: 2201); wherein X$_1$ is Q, H or E, wherein X$_2$ is F or Y, wherein X$_3$ is K, Y or I, wherein X$_4$ is N, T, L, I, or M; wherein X$_5$ is W, F, H or Y, wherein X$_6$ is absent or P; wherein X$_7$ is W, N, Y, H or L;

QX$_1$YX$_3$X$_4$X$_5$PX$_6$T (SEQ ID NO: 2207), wherein X$_1$ is Q or H, wherein X$_2$ is D, A or G, wherein X$_3$ is N or K; wherein X$_4$ is L or I, and wherein X$_5$ is I or L;

QQFKNWPPT (SEQ ID NO: 2222);

QHYDNLPIT (SEQ ID NO: 2223);

LQAHGFPWT (SEQ ID NO: 2224);

QQYDNLPLT (SEQ ID NO: 2225) and

QFWPPWT (SEQ ID NO: 2226).

In various embodiments, the TREM-1 antibody comprises an antigen binding domain comprising a sequence having a heavy chain variable region comprising a HCDR1 amino acid sequence selected from the group consisting of:

X$_1$X$_2$X$_3$MX$_4$ (SEQ ID NO: 2202), wherein X$_1$ is A, R, T or S, wherein X$_2$ is Y or N, wherein X$_3$ is A or W, and wherein X$_4$ is S or N;

X$_1$YDIN (SEQ ID NO: 2208), wherein X$_1$ is R or S; GYYX$_1$H (SEQ ID NO: 2723), wherein X$_1$ is M or I;

AYAMS (SEQ ID NO: 2227);

RYDIN (SEQ ID NO: 2228); and

SYWMS (SEQ ID NO: 2229).

In various embodiments, the TREM-1 antibody comprises an antigen binding domain comprising a sequence having a heavy chain variable region comprising a HCDR2 amino acid sequence selected from the group consisting of:

X$_1$X$_2$X$_3$X$_4$X$_5$X$_6$ X$_7$X$_8$ X$_9$YYX$_{10}$ X$_{11}$X$_{12}$VKG (SEQ ID NO: 2205), wherein X$_1$ is T, E, or S, wherein X$_2$ is absent or is M, V, or I, wherein X$_3$ is S, R or K, wherein X$_4$ is G or Q, wherein X$_5$ is S, D or H, wherein X$_6$ is G, S L, or A, wherein X$_7$ is S, G, or R, wherein X$_5$ is T, S, P or E, wherein X$_9$ is T or I, wherein X$_{10}$ is A or V, wherein X$_{11}$ is D or E, and wherein X$_{12}$ is S or A;

X$_1$X$_2$NPX$_3$X$_4$GX$_5$X$_6$GX$_7$X$_8$ X$_9$X$_{10}$FX$_{11}$X$_{12}$ (SEQ ID NO: 2209), wherein X$_1$ is W or R, wherein X$_2$ is M or L, wherein X$_3$ is N, Q, or K, wherein X$_4$ is S, A, or R, wherein X$_5$ is N, or Q, wherein X$_6$ is S, A, or T, wherein X$_7$ is S, Q, or Y, wherein X$_8$ is V or T, wherein X$_9$ is Q or K, wherein X$_{10}$ is K or N, wherein X$_{11}$ is R or Q, and wherein X$_{12}$ is G or D;

TSGSGSTTYYADSVKG (SEQ ID NO: 2230);

WMNPNSGNSSVQKFRG (SEQ ID NO: 2231);

NIKQDGSEEYYVDSVKG (SEQ ID NO: 2232); and

TSGSGTYYADSVKG (SEQ ID NO: 2669).

In various embodiments, the TREM-1 antibody comprises an antigen binding domain comprising a sequence having a heavy chain variable region comprising a HCDR3 amino acid sequence selected from the group consisting of:

X$_1$X$_2$X$_3$X$_4$X$_5$X$_6$ X$_7$ F X$_8$YYX$_9$ (SEQ ID NO: 2203), wherein X$_1$ is V, E, A or G, wherein X$_2$ is A, F, Y or G, wherein X$_3$ is G, S, Y or W, wherein X$_4$ is S or R, wherein X$_5$ is absent or is N, wherein X$_6$ is F, S, Y, or absent, wherein X$_7$ is L or F or absent, wherein X$_8$ is D or E, and wherein X$_9$ is Y, H or S;

X$_1$X$_2$X$_3$X$_4$ X$_5$X$_6$ X$_7$X$_8$ X$_9$X$_{10}$X$_{11}$X$_{12}$FX$_{13}$X$_{14}$ (SEQ ID NO: 2210); wherein X$_1$ is G, L or R, wherein X$_2$ is G, I, or R, wherein X$_3$ is Y, R, I, G, or A, wherein X$_4$ is T, S, Y, or V, wherein X$_5$ is S or Y, wherein X$_6$ is S, A, I, or R, wherein X$_7$ is W, A, or S, wherein X$_8$ is absent or is S, wherein X$_9$ is absent or is F, W, or Y, wherein X$_{10}$ is R, S, H, K, or E, wherein X$_{11}$ is W, H, Y, or F, wherein X$_{12}$ is Y, V, A, or S, wherein X$_{13}$ is D or Q, and wherein X$_{14}$ is L, Y, I, or H;

VAGSNFLFDY (SEQ ID NO: 2670);

GGYTSSWRWYFDL (SEQ ID NO: 2671);

GGYTSSWSRWYFDL (SEQ ID NO: 2672); and

DYGDSFDY (SEQ ID NO: 2673).

In various embodiments, provided herein is an isolated antigen binding protein, wherein the antigen binding protein:

a. is an antibody or antibody fragment;

b. binds to human TREM-1 having the amino acid sequence set forth in SEQ ID NO: 20;

c. comprises a light chain variable domain comprising:
   i. a light chain CDR1 comprising an amino acid sequence X$_1$ASQSX$_2$X$_3$X$_4$NLA (SEQ ID NO: 2199), wherein X$_1$ is R or Q, wherein X$_2$ is V or I, wherein X$_3$ is N or S, and wherein X$_4$ is S, H, I, V or A;
   ii. a light chain CDR2 comprising an amino acid sequence GAX$_1$X$_2$RAT (SEQ ID NO: 2200), wherein X$_1$ is S or Y, and wherein X$_2$ is T or I; and
   iii. a light chain CDR3 comprising an amino acid sequence QX$_1$X$_2$X$_3$X$_4$X$_5$X$_6$PX$_7$T (SEQ ID NO: 2201); wherein X$_1$ is Q, H or E, wherein X$_2$ is F or Y, wherein X$_3$ is K, Y or I, wherein X$_4$ is N, T, L, I, or M; wherein X$_5$ is W, F, H or Y, wherein X$_6$ is absent or P; wherein X$_7$ is W, N, Y, H or L; and d. comprises a heavy chain variable domain comprising:
   i. a heavy chain CDR1 comprising an amino acid sequence X$_1$X$_2$X$_3$MX$_4$ (SEQ ID NO: 2202), wherein X$_1$ is A, R, T or S, wherein X$_2$ is Y or N, wherein X$_3$ is A or W, and wherein X$_4$ is S or N;
   ii. a heavy chain CDR2 comprising an amino acid sequence X$_1$X$_2$X$_3$X$_4$X$_5$X$_6$ X$_7$X$_8$ X$_9$YYX$_{10}$ X$_{11}$X$_{12}$VKG (SEQ ID NO: 2205), wherein X$_1$ is T, E, or S, wherein X$_2$ is absent or is M, V, or I, wherein X$_3$ is S, R or K, wherein X$_4$ is G or Q, wherein X$_5$ is S, D or H, wherein X$_6$ is G, S L, or A, wherein X$_7$ is S, G, or R, wherein X$_8$ is T, S, P or E, wherein X$_9$ is T or I, wherein X$_{10}$ is A or V, wherein X$_{11}$ is D or E, and wherein X$_{12}$ is S or A; and
   iii. a heavy chain CDR3 comprising an amino acid sequence X$_1$X$_2$X$_3$X$_4$X$_5$X$_6$ X$_7$ F X$_8$YYX$_9$ (SEQ ID NO: 2203), wherein $X_1$ is V, E, A or G, wherein $X_2$ is A, F, Y or G, wherein $X_3$ is G, S, Y or W, wherein $X_4$ is S or R, wherein $X_5$ is absent or is N, wherein $X_6$ is F, S, Y, or absent, wherein $X_7$ is L or F or absent, wherein $X_8$ is D or E, and wherein $X_9$ is Y, H or S.

In various embodiments, the antigen binding protein comprises:

a. a light chain variable domain comprising:
   i. a light chain CDR1 comprising an amino acid sequence RASQSVNSNLA (SEQ ID NO: 2212);
   ii. a light chain CDR2 comprising an amino acid sequence GASTRAT (SEQ ID NO: 2219);
   iii. a light chain CDR3 comprising an amino acid sequence QQFKNWPPT (SEQ ID NO: 2222); and
b. a heavy chain variable domain comprising:
   i. a heavy chain CDR1 comprising an amino acid sequence AYAMS (SEQ ID NO: 2227);
   ii. a heavy chain CDR2 comprising an amino acid sequence TSGSGSTTYYADSVKG (SEQ ID NO: 2230); and
   iii. a heavy chain CDR3 comprising an amino acid sequence VAGSNFLFDY (SEQ ID NO: 2670).

In various embodiments, the disclosure provides an isolated antigen binding protein, wherein the antigen binding protein:

a. is an antibody or antibody fragment;
b. binds to human TREM-1 having the amino acid sequence set forth in SEQ ID NO: 20;
c. comprises a light chain variable domain comprising:
   i. a light chain CDR1 comprising an amino acid sequence QASX$_1$DIX$_2$X$_3$X$_4$LN (SEQ ID NO: 2204), wherein $X_1$ is R or Q, wherein $X_2$ is R, S, N or F, wherein $X_3$ is K or N, and wherein $X_4$ is H, Y or D;
   ii. a light chain CDR2 comprising an amino acid sequence $X_1X_2X_3X_4$LET (SEQ ID NO: 2206), wherein $X_1$ is D, G or H, wherein $X_2$ is A, V or T, wherein $X_3$ is S, A or Y, and wherein $X_4$ is T or N;
   iii. a light chain CDR3 comprising an amino acid sequence QX$_1$YX$_3$X$_4$X$_5$PX$_6$T (SEQ ID NO: 2207), wherein $X_1$ is Q or H, wherein $X_2$ is D, A or G, wherein $X_3$ is N or K; wherein $X_4$ is L or I, and wherein $X_5$ is I or L; and
d. comprises a heavy chain variable domain comprising:
   i. a heavy chain CDR1 comprising an amino acid sequence $X_1$YDIN (SEQ ID NO: 2208), wherein $X_1$ is R or S;
   ii. a heavy chain CDR2 comprising an amino acid sequence $X_1X_2$NPX$_3$X$_4$GX$_5$X$_6$GX$_7$X$_8$X$_9$X$_{10}$FX$_{11}$X$_{12}$ (SEQ ID NO: 2209), wherein $X_1$ is W or R, wherein $X_2$ is M or L, wherein $X_3$ is N, Q, or K, wherein $X_4$ is S, A, or R, wherein $X_5$ is N, or Q, wherein $X_6$ is S, A, or T, wherein $X_7$ is S, Q, or Y, wherein $X_8$ is V or T, wherein $X_9$ is Q or K, wherein $X_{10}$ is K or N, wherein $X_{11}$ is R or Q, and wherein $X_{12}$ is G or D; and
   iii. a heavy chain CDR3 comprising an amino acid sequence $X_1X_2X_3X_4$ $X_5X_6$ $X_7X_8$ $X_9X_{10}X_{11}X_{12}$FX$_{13}$X$_{14}$ (SEQ ID NO: 2210); wherein $X_1$ is G, L or R, wherein $X_2$ is G, I, or R, wherein $X_3$ is Y, R, I, G, or A, wherein $X_4$ is T, S, Y, or V, wherein $X_5$ is S or Y, wherein $X_6$ is S, A, I, or R, wherein $X_7$ is W, A, or S, wherein $X_8$ is absent or is S, wherein $X_9$ is absent or is F, W, or Y, and wherein $X_{10}$ is R, S, H, K, or E, wherein $X_{11}$ is W, H, Y, or F, wherein $X_{12}$ is Y, V, A, or S, wherein $X_{13}$ is D or Q, and wherein $X_{14}$ is L, Y, I, or H.

In various embodiments, the antigen binding protein comprises:

a. a light chain variable domain comprising:
   i. a light chain CDR1 comprising an amino acid sequence QASQDIRKHLN (SEQ ID NO: 2213);
   ii. a light chain CDR2 comprising an amino acid sequence DASNLET (SEQ ID NO: 2220); and
   iii. a light chain CDR3 comprising an amino acid sequence QHYDNLPIT (SEQ ID NO: 2223); and
b. a heavy chain variable domain comprising:
   i. a heavy chain CDR1 comprising an amino acid sequence RYDIN (SEQ ID NO: 2228);
   ii. a heavy chain CDR2 comprising an amino acid sequence WMNPNSGNSSVQKFRG (SEQ ID NO: 2231); and
   iii. a heavy chain CDR3 comprising an amino acid sequence GGYTSSWRWYFDL (SEQ ID NO: 2671) or GGYTSSWSRWYFDL (SEQ ID NO: 2672).

In various embodiments, the disclosure provides an isolated antigen binding protein, wherein the antigen binding protein:

a. is an antibody or antibody fragment;
b. binds to human TrigGering Receptor Expressed on Myeloid cells 1 (TREM-1) having the amino acid sequence set forth in SEQ ID NO: 20;
c. comprises a set of CDR sequences selected from:
   i) SEQ ID NO: 30 (LCDR1), SEQ ID NO: 31 (LCDR2), SEQ ID NO: 32 (LCDR3), SEQ ID NO: 36 (HCDR1), SEQ ID NO: 37 (HCDR2) and SEQ ID NO: 38 (HCDR3);
   ii) SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3);
   iii) SEQ ID NO: 70 (LCDR1), SEQ ID NO: 71 (LCDR2), SEQ ID NO: 72 (LCDR3), SEQ ID NO: 76 (HCDR1), SEQ ID NO: 77 (HCDR2) and SEQ ID NO: 78 (HCDR3);
   iv) SEQ ID NO: 90 (LCDR1), SEQ ID NO: 91 (LCDR2), SEQ ID NO: 92 (LCDR3), SEQ ID NO: 96 (HCDR1), SEQ ID NO: 97 (HCDR2) and SEQ ID NO: 98 (HCDR3);
   v) SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) and SEQ ID NO: 118 (HCDR3);
   vi) SEQ ID NO: 130 (LCDR1), SEQ ID NO: 131 (LCDR2), SEQ ID NO: 132 (LCDR3), SEQ ID NO: 136 (HCDR1), SEQ ID NO: 137 (HCDR2) and SEQ ID NO: 138 (HCDR3);
   vii) SEQ ID NO: 150 (LCDR1), SEQ ID NO: 151 (LCDR2), SEQ ID NO: 152 (LCDR3), SEQ ID NO: 156 (HCDR1), SEQ ID NO: 157 (HCDR2) and SEQ ID NO: 158 (HCDR3);
   viii) SEQ ID NO: 170 (LCDR1), SEQ ID NO: 171 (LCDR2), SEQ ID NO: 172 (LCDR3), SEQ ID NO: 176 (HCDR1), SEQ ID NO: 177 (HCDR2) and SEQ ID NO: 178 (HCDR3);
   ix) SEQ ID NO: 190 (LCDR1), SEQ ID NO: 191 (LCDR2), SEQ ID NO: 192 (LCDR3), SEQ ID NO: 196 (HCDR1), SEQ ID NO: 197 (HCDR2) and SEQ ID NO: 198 (HCDR3);

x) SEQ ID NO: 210 (LCDR1), SEQ ID NO: 211 (LCDR2), SEQ ID NO: 212 (LCDR3), SEQ ID NO: 216 (HCDR1), SEQ ID NO: 217 (HCDR2) and SEQ ID NO: 218 (HCDR3);

xi) SEQ ID NO: 230 (LCDR1), SEQ ID NO: 231 (LCDR2), SEQ ID NO: 232 (LCDR3), SEQ ID NO: 236 (HCDR1), SEQ ID NO: 237 (HCDR2) and SEQ ID NO: 238 (HCDR3);

xii) SEQ ID NO: 250 (LCDR1), SEQ ID NO: 251 (LCDR2), SEQ ID NO: 252 (LCDR3), SEQ ID NO: 256 (HCDR1), SEQ ID NO: 257 (HCDR2) and SEQ ID NO: 258 (HCDR3);

xiii) SEQ ID NO: 270 (LCDR1), SEQ ID NO: 271 (LCDR2), SEQ ID NO: 272 (LCDR3), SEQ ID NO: 276 (HCDR1), SEQ ID NO: 277 (HCDR2) and SEQ ID NO: 278 (HCDR3);

xiv) SEQ ID NO: 290 (LCDR1), SEQ ID NO: 291 (LCDR2), SEQ ID NO: 292 (LCDR3), SEQ ID NO: 296 (HCDR1), SEQ ID NO: 297 (HCDR2) and SEQ ID NO: 298 (HCDR3); or xv) SEQ ID NO: 2190 (LCDR1), SEQ ID NO: 2191 (LCDR2), SEQ ID NO: 2192 (LCDR3), SEQ ID NO: 2196 (HCDR1), SEQ ID NO: 2197 (HCDR2) and SEQ ID NO: 2198 (HCDR3).

In various embodiments, the anti-TREM-1 antigen-binding protein comprises a set of CDR sequences selected from:

i) SEQ ID NO: 30 (LCDR1), SEQ ID NO: 31 (LCDR2), SEQ ID NO: 32 (LCDR3), SEQ ID NO: 36 (HCDR1), SEQ ID NO: 37 (HCDR2) and SEQ ID NO: 38 (HCDR3);

ii) SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3);

iii) SEQ ID NO: 70 (LCDR1), SEQ ID NO: 71 (LCDR2), SEQ ID NO: 72 (LCDR3), SEQ ID NO: 76 (HCDR1), SEQ ID NO: 77 (HCDR2) and SEQ ID NO: 78 (HCDR3);

iv) SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) and SEQ ID NO: 118 (HCDR3);

v) SEQ ID NO: 150 (LCDR1), SEQ ID NO: 151 (LCDR2), SEQ ID NO: 152 (LCDR3), SEQ ID NO: 156 (HCDR1), SEQ ID NO: 157 (HCDR2) and SEQ ID NO: 158 (HCDR3);

vi) SEQ ID NO: 170 (LCDR1), SEQ ID NO: 171 (LCDR2), SEQ ID NO: 172 (LCDR3), SEQ ID NO: 176 (HCDR1), SEQ ID NO: 177 (HCDR2) and SEQ ID NO: 178 (HCDR3); or vii) SEQ ID NO: 290 (LCDR1), SEQ ID NO: 291 (LCDR2), SEQ ID NO: 292 (LCDR3), SEQ ID NO: 296 (HCDR1), SEQ ID NO: 297 (HCDR2) and SEQ ID NO: 298 (HCDR3).

In various embodiments, the anti-TREM-1 antigen binding protein comprises a set of CDR sequences selected from: SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) AND SEQ ID NO: 58 (HCDR3; or SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) AND SEQ ID NO: 118 (HCDR3).

In various embodiments, the anti-TREM-1 antigen-binding protein or anti-TREM1 antigen-binding portion of an antigen binding protein comprises:

a. a light chain variable domain comprising an amino acid sequence selected from the group consisting of:

i. a sequence at least 80% identical to an amino acid sequence selected from SEQ ID NOS: 41, 61, 81, 101, 121, 141, 161, 181, 201, 221, 241, 261, 281 301 and 2185;

ii. a sequence encoded by a polynucleotide sequence that is at least 80% identical to a nucleic acid sequence selected from SEQ ID NOS: 39, 59, 79, 99, 119, 139, 159, 179, 199, 219, 239, 259, 279, 299and 2183;

iii. a sequence encoded by a polynucleotide that hybridizes under moderately stringent conditions to the complement of a polynucleotide consisting of a nucleic acid sequence selected from SEQ ID NOS: 39, 59, 79, 99, 119, 139, 159, 179, 199, 219, 239, 259, 279 299 and 2183; and b. a heavy chain variable domain comprising an amino acid sequence selected from the group consisting of:

i. a sequence that is at least 80% identical to an amino acid sequence selected from SEQ ID NOS: 42, 62, 82, 102, 122, 142, 162, 182, 202, 222, 242, 262, 282, 302 and 2186;

ii. a sequence encoded by a polynucleotide sequence that is at least 80% identical to an amino acid sequence selected from SEQ ID NOS: 40, 60, 80, 100, 120, 140, 160, 180, 200, 220, 240, 260, 280, 300 and 2184;

iii. a sequence encoded by a polynucleotide that hybridizes under moderately stringent conditions to the complement of a polynucleotide consisting of a nucleic sequence selected from SEQ ID NOS: 40, 60, 80, 100, 120, 140, 160, 180, 200, 220, 240, 260, 280, 300 and 2184.

In various embodiments, the anti-TREM-1 antigen-binding protein or anti-TREM1 antigen-binding portion of an antigen binding protein comprises:

a. a light chain variable domain comprising an amino acid sequence selected from the group consisting of:

i. a sequence at least 80% identical to an amino acid sequence selected from SEQ ID NOS: 41, 61, 81, 121, 161, 181, and 301;

ii. a sequence encoded by a polynucleotide sequence that is at least 80% identical to a nucleic acid sequence selected from SEQ ID NOS: 39, 59, 79, 119, 159, 179, and 299;

iii. a sequence encoded by a polynucleotide that hybridizes under moderately stringent conditions to the complement of a polynucleotide consisting of a nucleic acid sequence selected from SEQ ID NOS: 39, 59, 79, 119, 159, 179, and 299; and b. a heavy chain variable domain comprising an amino acid sequence selected from the group consisting of:

i. a sequence that is at least 80% identical to an amino acid sequence selected from SEQ ID NOS: 42, 62, 82, 122, 162, 182, and 302;

ii. a sequence encoded by a polynucleotide sequence that is at least 80% identical to an amino acid sequence selected from SEQ ID NOS: 40, 60, 80, 120, 160, 180, and 300;

iii. a sequence encoded by a polynucleotide that hybridizes under moderately stringent conditions to the complement of a polynucleotide consisting of a nucleic sequence selected from SEQ ID NOS: 40, 60, 80, 120, 160, 180 and 300.

In various embodiments, the anti-TREM-1 antigen-binding protein or anti-TREM1 antigen-binding portion of an antigen binding protein comprises:

a. a light chain variable domain comprising an amino acid sequence selected from the group consisting of:

i. a sequence at least 80% identical to an amino acid sequence selected from SEQ ID NOS: 61 and 121;

ii. a sequence encoded by a polynucleotide sequence that is at least 80% identical to a nucleic acid sequence selected from SEQ ID NOS: 59 and 119;

iii. a sequence encoded by a polynucleotide that hybridizes under moderately stringent conditions to the complement of a polynucleotide consisting of a nucleic acid sequence selected from SEQ ID NOS: 59 and 119; and b. a heavy chain variable domain comprising an amino acid sequence selected from the group consisting of:

i. a sequence that is at least 80% identical to an amino acid sequence selected from SEQ ID NOS: 62 and 122;

ii. a sequence encoded by a polynucleotide sequence that is at least 80% identical to an amino acid sequence selected from SEQ ID NOS: 60 and 120;

iii. a sequence encoded by a polynucleotide that hybridizes under moderately stringent conditions to the complement of a polynucleotide consisting of a nucleic sequence selected from SEQ ID NOS: 60 and 120.

In various embodiments, the anti-TREM-1 antigen-binding protein or anti-TREM1 antigen-binding portion of an antigen binding protein comprises:

i) a light chain variable domain set out in SEQ ID NO: 41 and a heavy chain variable domain set out in SEQ ID NO: 42;

ii) a light chain variable domain set out in SEQ ID NO: 61 and a heavy chain variable domain set out in SEQ ID NO: 62;

iii) a light chain variable domain set out in SEQ ID NO: 81 and a heavy chain variable domain set out in SEQ ID NO: 82;

iv) a light chain variable domain set out in SEQ ID NO: 101 and a heavy chain variable domain set out in SEQ ID NO: 102;

v) a light chain variable domain set out in SEQ ID NO: 121 and a heavy chain variable domain set out in SEQ ID NO: 122;

vi) a light chain variable domain set out in SEQ ID NO: 161 and a heavy chain variable domain set out in SEQ ID NO: 162;

vii) a light chain variable domain set out in SEQ ID NO: 181 and a heavy chain variable domain set out in SEQ ID NO: 182;

viii) a light chain variable domain set out in SEQ ID NO: 201 and a heavy chain variable domain set out in SEQ ID NO: 202;

x) a light chain variable domain set out in SEQ ID NO: 221 and a heavy chain variable domain set out in SEQ ID NO: 222;

xi) a light chain variable domain set out in SEQ ID NO: 241 and a heavy chain variable domain set out in SEQ ID NO: 242;

xii) a light chain variable domain set out in SEQ ID NO: 261 and a heavy chain variable domain set out in SEQ ID NO: 262;

xiii) a light chain variable domain set out in SEQ ID NO: 281 and a heavy chain variable domain set out in SEQ ID NO: 282;

xiv) a light chain variable domain set out in SEQ ID NO: 301 and a heavy chain variable domain set out in SEQ ID NO: 302; or xv) a light chain variable domain set out in SEQ ID NO: 2185 and a heavy chain variable domain set out in SEQ ID NO: 2186.

In various embodiments, the anti-TREM-1 antigen-binding protein or anti-TREM1 antigen-binding portion of an antigen binding protein comprises:

i) a light chain variable domain set out in SEQ ID NO: 41 and a heavy chain variable domain set out in SEQ ID NO: 42;

ii) a light chain variable domain set out in SEQ ID NO: 61 and a heavy chain variable domain set out in SEQ ID NO: 62;

iii) a light chain variable domain set out in SEQ ID NO: 81 and a heavy chain variable domain set out in SEQ ID NO: 82;

iv) a light chain variable domain set out in SEQ ID NO: 121 and a heavy chain variable domain set out in SEQ ID NO: 122;

v) a light chain variable domain set out in SEQ ID NO: 161 and a heavy chain variable domain set out in SEQ ID NO: 162;

vi) a light chain variable domain set out in SEQ ID NO: 181 and a heavy chain variable domain set out in SEQ ID NO: 182; or vii) a light chain variable domain set out in SEQ ID NO: 301 and a heavy chain variable domain set out in SEQ ID NO: 302.

In various embodiments, the anti-TREM-1 antigen-binding protein or anti-TREM1 antigen-binding portion of an antigen binding protein comprises: a light chain variable domain set out in SEQ ID NO: 61 and a heavy chain variable domain set out in SEQ ID NO: 62; or a light chain variable domain set out in SEQ ID NO: 121 and a heavy chain variable domain set out in SEQ ID NO: 122.

In various embodiments, the amino acid sequences can be 80%, 85%, 90%, 91%, 92%, 93%, 94%, 95%, 96%, 97%, 98% or 99% identical to SEQ ID NOs: 42, 62, 82, 102. 122, 142, 162, 182, 202, 222, 242, 262, 282, 302 and 2186, and SEQ ID NOS: 41, 61, 81, 101, 121, 141,161, 181, 201, 221, 241, 261, 281, 301 and 2185.

In various embodiments, the antigen binding protein comprises an amino acid sequence at least 90% identical to a heavy chain variable region amino acid sequence selected from SEQ ID NOS: 42, 62, 82, 102. 122, 142, 162, 182, 202, 222, 242, 262, 282, 302 and 2186.

In various embodiments, the antigen-binding protein comprises an amino acid sequence at least 90% identical to a light chain variable region amino acid sequence set forth in SEQ ID NO: 41, 61, 81, 101, 121, 141, 161, 181, 201, 221, 241, 261, 281, 301 and 2185.

In various embodiments, the antigen binding protein comprises an amino acid sequence at least 90% identical to a heavy chain variable region amino acid sequence selected from SEQ ID NOS: 42, 62, 82, 122, 162, 182, and 302. In various embodiments, the antigen-binding protein comprises an amino acid sequence at least 90% identical to a light chain variable region amino acid sequence selected from SEQ ID NO: 41, 61, 81, 121, 161, 181, and 301.

In various embodiments, the antigen binding protein comprises an amino acid sequence at least 90% identical to a heavy chain variable region amino acid sequence selected from SEQ ID NOS: 62 and 122. In various embodiments, the antigen-binding protein comprises an amino acid sequence at least 90% identical to a light chain variable region amino acid sequence selected from SEQ ID NO: 61 and 121.

In various embodiments, one or more heavy chain framework amino acids of the anti-antigen-binding protein are replaced with corresponding amino acid(s) from another human antibody amino acid sequence. In various embodiments, one or more light chain framework amino acids of the antigen-binding protein are replaced with corresponding amino acid(s) from another human antibody amino acid sequence.

In some instances, a sequence disclosed herein may contain an N-terminal signal sequence useful for recombinant production. Contemplated herein are sequences of anti-TREM-1 antibodies or antigen binding proteins lacking the signal sequences. Exemplary signal sequences include MDMRVPAQLLGLLLLWLRGARC (SEQ ID NO: 2674); MAWALLLLTLLTQGTGSWASYEL (SEQ ID NO: 2675), and nucleic acids encoding such signal sequences.

In various embodiments, the anti-TREM-1 antigen binding protein further comprises a human light chain constant region attached to said light chain variable region.

In various embodiments, the heavy chain constant region is selected from heavy chain constant regions of an IgG, IgM, IgA, IgD, IgE, fragments thereof, combinations thereof, and modifications thereof in which one to ten heavy chain framework amino acids are replaced with corresponding amino acid(s) from another human antibody amino acid sequence.

In various embodiments, the anti-TREM-1 antigen-binding protein described herein inhibits binding of a TREM-1 ligand to TREM-1.

Also contemplated is an antigen binding protein that competes for binding to a human TREM-1 protein having the sequence of SEQ ID NO: 20 with an anti-TREM-1 antigen binding protein as described herein.

In various embodiments, the antigen-binding protein is selected from the group consisting of a human antibody, a humanized antibody, a chimeric antibody, a monoclonal antibody, a recombinant antibody, a Fab, a F(ab')2, a Fab2, a monovalent IgG, an scFv, an scFv-Fc, an IgG1 antibody, an IgG2 antibody, an IgG3 antibody, and an IgG4 antibody. In various embodiments, the anti-TREM-1 antigen-binding protein is an IgG2 antibody. In various embodiments, the anti-TREM-1 antigen-binding protein is an IgG1 antibody. In various embodiments, the IgG1 antibody is an IGg1z or IgG1z-SEFL2 antibody. In various embodiments, the antigen-binding protein is a monovalent IgG.

In various embodiments, the antigen-binding protein is a human antibody.

Also provided is an isolated nucleic acid molecule comprising a nucleotide sequence that encodes the heavy chain of an anti-TREM-1 antigen binding protein as described herein, an isolated nucleic acid molecule comprising a nucleotide sequence that encodes the light chain of an anti-TREM-1 antigen binding protein as described herein, and an isolated nucleic acid molecule comprising a nucleotide sequence that encodes the heavy chain and light chain of an anti-TREM-1 antigen binding protein as described herein.

In various embodiments, the antigen binding protein comprises an amino acid sequence at least 90% identical to a heavy chain variable region polynucleotide sequence selected from SEQ ID NOS: 40, 60, 80, 100, 120, 140, 160, 180, 200, 220, 240, 260, 280 and 300, and 2184. In various embodiments, the antigen-binding protein comprises an amino acid sequence at least 90% identical to a light chain variable region polynucleotide sequence set forth in SEQ ID NO: 39, 59, 79, 99, 119, 139, 159, 179, 199, 219, 239, 259, 279 299 and 2183.

In various embodiments, the antigen binding protein comprises an amino acid sequence at least 90% identical to a heavy chain variable region polynucleotide sequence selected from SEQ ID NOS: 40, 60, 80, 120, 160, 180, and 300. In various embodiments, the antigen-binding protein comprises an amino acid sequence at least 90% identical to a light chain variable region polynucleotide sequence selected from SEQ ID NO: 39, 59, 79, 119, 159, 179, and 299.

In various embodiments, the antigen binding protein comprises an amino acid sequence at least 90% identical to a heavy chain variable region polynucleotide sequence selected from SEQ ID NOS: 60 and 120. In various embodiments, the antigen-binding protein comprises an amino acid sequence at least 90% identical to a light chain variable region polynucleotide sequence selected from SEQ ID NO: 59 and 119.

Further contemplated is an expression vector comprising the nucleic acid molecules of an anti-TREM-1 antigen binding protein heavy and/or light chain as described herein operably linked to an expression control sequence.

The disclosure provides a recombinant host cell comprising the nucleic acid molecule comprising a nucleotide sequence encoding the heavy chain of an anti-TREM-1 antigen binding protein or antibody as described herein; or the nucleic acid molecule encoding the light chain or an anti-TREM-1 antibody as described herein; or the nucleic acid molecule encoding a heavy chain and light chain nucleic acid molecule of an anti-TREM-1 antibody as described herein; or the vector comprising the nucleic acid molecules encoding the heavy and/or light chain of an anti-TREM-1 antibody as described herein. In various embodiments, the host cell is a mammalian cell. In various embodiments, the host cell is a CHO cell.

Further provided is a method of using the host cell to produce an antigen-binding protein, comprising culturing the host cell and recovering said antigen-binding protein, and an antigen-binding protein produced by the method.

Also provided is a sterile pharmaceutical composition comprising the anti-TREM-1 antigen binding protein as described herein and a pharmaceutically acceptable carrier.

Further contemplated is an antigen binding protein comprising an antigen-binding moiety and one or two IL-10 moieties wherein:

a. the antigen-binding moiety is an antibody or antibody fragment, b. each IL-10 moiety is independently monovalent or bivalent, c. each IL-10 moiety is independently selected from one or more human IL-10 muteins having sequences that are 90% identical to SEQ ID NO: 2, and d. at least one IL-10 moiety is covalently bound to the antigen-binding moiety.

In various embodiments, at least one IL-10 moiety is fused to a C-terminus of the antigen-binding moiety. In various embodiments, at least one IL-10 moiety is fused to an N-terminus of the antigen-binding moiety. In various embodiments, at least one IL-10 moiety is fused to an N and C terminus of the antigen binding moiety. In various embodiments, the IL-10 moiety is fused at an internal site in the antigen binding moiety. In various embodiments, at least one IL-10 moiety is fused to a heavy and/or light chain of the antigen-binding moiety. In various embodiments, the heavy chain and/or light chain is a modified or engineered heavy chain or light chain.

Also provided is an antigen binding protein comprising:

(a) a polypeptide sequence having the formula A-L-M or M-L-A, wherein

US 12,630,598 B2

15 i) A is an immunoglobulin heavy chain of an IgG antibody that binds to a TREM-1 protein set out in SEQ ID NO: 20, ii) L is a linker peptide comprising from 4 to 20 amino acids and iii) M is a mutein of IL-10 having at least 90% sequence identity to wt IL-10 set out in SEQ ID NO: 2; and (b) an immunoglobulin light chain of an IgG antibody that binds TREM-1 protein set out in SEQ ID NO: 20, wherein the immunoglobulin heavy chain of (a) and the immunoglobulin light chain of (b) form an IgG antibody moiety that binds TREM-1, wherein the protein comprises one or two molecules of the polypeptide of (a) and one or two molecules of the light chain of (b), optionally wherein only 1 polypeptide of (a) comprises an M moiety.

In various embodiments, the antigen binding protein reduces the suppression of TNF-α production in myeloid cells, reduces levels of CD8+ T cell stimulation, and/or reduces the level of B cell stimulation compared to wt IL-10.

In various embodiments of the antigen binding protein:
a. the antigen-binding moiety is an antibody and
b. an IL-10 moiety is fused to each heavy chain of the antibody.

In various embodiments of the antigen binding protein, each IL-10 moiety is a monomer. In various embodiments the antigen binding protein comprises two different mutein monomers. In various embodiments, the antigen binding protein comprises two of the same mutein monomers.

In various embodiments of the antigen binding protein: each IL-10 moiety comprises an amino acid sequence that is at least 90% identical to the amino acid sequence set forth in SEQ ID NO: 2 and each IL-10 moiety independently comprises at least one mutation selected from a mutation in helical loop AB, helical loop CD, helical loop DE, helix A, helix B, helix C, helix D, helix E and/or helix F.

In various embodiments of the antigen binding protein, at least one IL-10 moiety comprises at least one mutation in helix A. In various embodiments of the antigen binding protein, at least one IL-10 moiety comprises at least one mutation in helix F. In various embodiments of the antigen binding protein, at least one IL-10 moiety comprises at least one mutation in helical loop AB.

In various embodiments, the anti-TREM-1/IL-10 mutein antigen binding protein lacks CD8+ T cell stimulation and/or B cell stimulation in a human subject, for example as compared to wt IL-10.

In various embodiments, the IL-10 mutein reduces the suppression of TNF-α production in myeloid cells, reduces levels of CD8+ T cell stimulation, and/or reduces the level of B cell stimulation compared to wt IL-10.

In various embodiments, the IL-10 mutein antigen binding protein, for example an anti-TREM-1/IL-10 mutein antigen binding protein, suppresses TNF-α production in myeloid cells. In various embodiments, the IL-10 mutein antigen binding protein, for example an anti-TREM-1/IL-10 mutein antigen binding protein, suppresses TNF-α production in myeloid cells, but still lacks CD8+ T cell and B cell activation.

In various embodiments, the antigen binding protein with IL-10 mutein fused to the antigen binding partner against cell surface proteins on CD8+ cells and/or B cells enhances levels of CD8+ T cell stimulation and/or levels of B cell stimulation in a human subject.

In various embodiments of the antigen binding protein, each IL-10 mutein independently comprises a mutation in one or more of residues N10, H14, F15, P20, M22, L23, R24, R27, D28, K34, T35, Q38, M39, K40, D41, Q42, L43, D44, N45, L46, L47, L48, K49, F56, K57, Y59, L60, Q63, E67, Q70, M77, Q79, N82, Q83, D84, P85, D86, I87, A89, H90, S93, T100, L103, H109, R110, L112, E115, N116, A127, K130, I136, Y137, K138, S141, E142, D144, I145, E151, M154, M156, K157, N160 of SEQ ID NO: 2 and/or an addition of 4-8 amino acids between helix D and helix E.

In various embodiments, each IL-10 mutein independently comprises one or more mutations selected from the group consisting of R27L, K34D, D41G, L46K, Q38E, Q38R, Q38D, K138L, K138D, or I87A of SEQ ID NO: 2, optionally comprising an addition of amino acids between helix D and helix E. In various embodiments, each IL-10 mutein independently comprises one or more mutations selected from the group consisting of N100, N101, N10K, R27L, K34D, D41G, L46K, Q38E, Q38R, Q38D, K138L, K138D, I87A, H14Q, F15Y, M22V, K49T, K49S, F56Y, K57N, Y59T, L600, Q63E, Q63L, E67C, Q70E, Q70K, M77R, M77V, Q79R, Q79C, D84R, A89P, H90E, H90Q, S93E, S93Q, T100R, L103E, H109D, R110P, R110O, L112V, E115K, N116D, N116Q, A127M, K130Q, I136C, Y137C, M154V, M156C, K157N, or N160D of SEQ ID NO: 2, optionally comprising an addition of amino acids between helix D and helix E.

In various embodiments, each IL-10 mutein independently comprises one or more mutations selected from the group consisting of R27L, K34D, D41G, L46K, Q38E, Q38R, Q38D, K138L, K138D, or I87A of SEQ ID NO: 2, optionally comprising an addition of six amino acids between helix D and helix E. In various embodiments, the amino acids between helix D and helix E are GGGSGG (SEQ ID NO: 2676). In various embodiments, each IL-10 mutein independently comprises one or more mutations selected from the group consisting of N10Q, N101, N10K, R27L, K34D, D41G, L46K, Q38E, Q38R, Q38D, K138L, K138D, I87A, H14Q, F15Y, M22V, K49T, K49S, F56Y, K57N, Y59T, L600, Q63E, Q63L, E67C, Q70E, 070K, M77R, M77V, Q79R, 079C, D84R, A89P, H90E, H90Q, S93E, S93Q, T100R, 103E, H109D, R110P, R110Q, L112V, Ei15K, N116D, N116Q, A127M, K130Q, I136C, Y137C, M154V, M156C, K157N, or N160D of SEQ ID NO: 2, optionally comprising an addition of six amino acids between helix D and helix E. In various embodiments, the amino acids between helix D and helix E are GGGSGG (SEQ ID NO: 2676).

In various embodiments of the antigen binding protein, each IL-10 mutein is at least 95% identical to the amino acid sequence set forth in SEQ ID NO: 2. In various embodiments, the amino acid sequence of the IL-10 mutein is set out in SEQ ID NO: 3-10. In various embodiments, the amino acid sequence of the IL-10 mutein is set out in SEQ ID NO: 3-10 and SEQ ID NOS: 2138, 2140, 2142, 2144, 2146, 2148, 2150, 2152, 2154, 2156, 2158, 2160, 2162, 2164, 2166, 2168, 2170 2172, 2174, 2176, 2178, 2180, 2182, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2500, 2502, 2504, 2506, 2508, 2510, 2512, 2514, 2516, 2518, 2520, 2522, 2524, 2526, 2528, 2530, 2532, 2534, 2536, 2538, 2540 and 2777-2791.

In various embodiments, the antigen binding protein comprises at least one linker fused to at least one C-terminus of the antigen-binding moiety and an IL-10 moiety is covalently bound to the C-terminus of each linker. In various embodiments, the linker is between 4 and 18 amino acids long. In various embodiments, the linker is six amino acids long. In various embodiments, the linker is a 3-mer, 4-mer, 5-mer, 6-mer, 7-mer or 8-mer peptide. In various embodiments, the linker comprises GS residues.

In various embodiments, the antigen binding protein comprises a "buried" IL-10 mutein. In various embodiments, the antigen binding protein comprises: (a) a Fab portion of an anti-TREM1 binding moiety, (b) at least one G4 linker fused to C-terminus of the Fab portion of the TREM1-binding moiety, (c) an IL-10 moiety is covalently bound to the C-terminus of each linker; another G4 linker is fused to the C-terminus of the IL10 moiety; the Fc region is covalently attached to the C-terminus of this second G4 linker. Additional linkers contemplated are described further in the Detailed Description.

In various embodiments, the antigen binding moiety in the antigen binding protein further comprises a human heavy chain constant region attached to said heavy chain variable region of the antibody portion of the antigen binding protein. In various embodiments, the antigen binding protein further comprises a human light chain constant region attached to said light chain variable region of the antibody portion of the antigen binding protein.

In various embodiments of the antigen binding protein, the antigen-binding moiety is selected from the group consisting of a human antibody, a humanized antibody, a chimeric antibody, a monoclonal antibody, a recombinant antibody, a Fab, a F(ab')2, a Fab2, a monovalent IgG, an scFv, an scFv-Fc, an IgG1 antibody, an IgG2 antibody, an IgG3 antibody, and an IgG4 antibody. In various embodiments, the antigen-binding moiety is an IgG. In various embodiments, the antigen-binding moiety is an IgG2 antibody. In various embodiments, the antigen-binding moiety is an IgG1 antibody. In various embodiments of the antigen binding protein, the antibody is an IgG1z or IgG1z-SEFL2 antibody. In various embodiments, the antigen-binding moiety is a monovalent IgG. In various embodiments, the heavy chain constant region of the antigen-binding moiety is selected from heavy chain constant regions of an IgG, IgM, IgA, IgD, IgE, fragments thereof, combinations thereof, and modifications thereof in which one to ten heavy chain framework amino acids are replaced with corresponding amino acid(s) from another human antibody constant region.

In various embodiments of the antigen binding protein, the antigen-binding moiety binds to human PD-1 having the amino acid sequence set forth in SEQ ID NO: 22. In various embodiments, the antigen-binding moiety binds to human TREM-1 having the amino acid sequence set forth in SEQ ID NO: 20. In various embodiments, the antigen-binding moiety binds to the human TREM-1 with a binding affinity of at least $10^{-8}$ M. In various embodiments, the antigen binding moiety binds its antigen with a binding affinity of at least $10^{-8}$ M to $10^{-15}$ M or $10^{-8}$ M to $10^{-12}$ M, or $10^{-8}$ M, $10^{-9}$ M, $10^{-10}$ M, $10^{-11}$ M, $10^{-12}$ M, $10^{-13}$ M, $10^{-14}$ M, or $10^{-15}$ M.

In various embodiments of the antigen binding protein, the anti-TREM-1 antigen binding moiety comprises:
a. a light chain variable domain comprising:
i. a light chain CDR1 comprising an amino acid sequence selected from SEQ ID NOS: 30, 50, 70, 90, 110, 130, 150, 170, 190, 210, 230, 250, 270, 290 and 2190;

ii. a light chain CDR2 sequence comprising an amino acid sequence selected from SEQ ID NOS: 31, 51, 71, 91, 111, 131, 151, 171, 191, 211, 231, 251, 271, 291 and 2191;
iii. a light chain CDR3 sequence comprising an amino acid sequence selected from SEQ ID NOS: 32, 52, 72, 92, 112, 132, 152, 172, 192, 212, 232, 252, 272, 292 and 2192; and
b. comprises a heavy chain variable domain comprising:
i. a heavy chain CDR1 comprising an amino acid sequence selected from SEQ ID NOS: 36, 56, 76, 96, 116, 136, 156, 176, 196, 216, 236, 256, 276, 296 and 2196;
ii. a heavy chain CDR2 sequence comprising an amino acid sequence selected from SEQ ID NOS: 37, 57, 77, 97, 117, 137, 157, 177, 197, 217, 237, 257, 277, 297 and 2197; and
iii. a heavy chain CDR3 sequence comprising an amino acid sequence selected from SEQ ID NOS: 38, 58, 78, 98, 118, 138, 158, 178, 198, 218, 238, 258, 278, 298 and 2198.

In various embodiments of the antigen binding protein, the anti-TREM-1 antigen binding moiety comprises:
a. the light chain CDR1 sequence is set out in SEQ ID NO: 30, 50, 70, 110, 150, 170, or 290;
b. the light chain CDR2 sequence is set out in SEQ ID NO: 31, 51, 71, 111, 151, 171, or 291;
c. the light chain CDR3 sequence is set out in SEQ ID NO: 32, 52, 72, 112, 152, 172, or 292
d. the heavy chain CDR1 sequence is set out in SEQ ID NO: 36, 56, 76, 116, 156, 176, or 296;
e. the heavy chain CDR2 sequence is set out in SEQ ID NO: 37, 57, 77, 117, 157, 177, or 297; and
f. the heavy chain CDR3 sequence is set out in SEQ ID NO: 38, 58, 78, 118, 158, 178, or 298.

In various embodiments of the antigen binding protein, the anti-TREM-1 antigen binding moiety comprises:
a. the light chain CDR1 sequence is set out in SEQ ID NO: 50 or 110;
b. the light chain CDR2 sequence is set out in SEQ ID NO: 51 or 111;
c. the light chain CDR3 sequence is set out in SEQ ID NO: 52 or 112;
d. the heavy chain CDR1 sequence is set out in SEQ ID NO: 56 or 116;
e. the heavy chain CDR2 sequence is set out in SEQ ID NO: 57 or 117; and
f. the heavy chain CDR3 sequence is set out in SEQ ID NOS: 58 or 118.

In various embodiments, the anti-TREM-1 antigen-binding protein or anti-TREM1 antigen-binding portion of an antigen binding protein comprises a set of CDR sequences selected from:
i) SEQ ID NO: 30 (LCDR1), SEQ ID NO: 31 (LCDR2), SEQ ID NO: 32 (LCDR3), SEQ ID NO: 36 (HCDR1), SEQ ID NO: 37 (HCDR2) and SEQ ID NO: 38 (HCDR3);
ii) SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3);
iii) SEQ ID NO: 70 (LCDR1), SEQ ID NO: 71 (LCDR2), SEQ ID NO: 72 (LCDR3), SEQ ID NO: 76 (HCDR1), SEQ ID NO: 77 (HCDR2) and SEQ ID NO: 78 (HCDR3);

19 iv) SEQ ID NO: 90 (LCDR1), SEQ ID NO: 91 (LCDR2), SEQ ID NO: 92 (LCDR3), SEQ ID NO: 96 (HCDR1), SEQ ID NO: 97 (HCDR2) and SEQ ID NO: 98 (HCDR3);

v) SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) and SEQ ID NO: 118 (HCDR3);

vi) SEQ ID NO: 130 (LCDR1), SEQ ID NO: 131 (LCDR2), SEQ ID NO: 132 (LCDR3), SEQ ID NO: 136 (HCDR1), SEQ ID NO: 137 (HCDR2) and SEQ ID NO: 138 (HCDR3);

vii) SEQ ID NO: 150 (LCDR1), SEQ ID NO: 151 (LCDR2), SEQ ID NO: 152 (LCDR3), SEQ ID NO: 156 (HCDR1), SEQ ID NO: 157 (HCDR2) and SEQ ID NO: 158 (HCDR3);

viii) SEQ ID NO: 170 (LCDR1), SEQ ID NO: 171 (LCDR2), SEQ ID NO: 172 (LCDR3), SEQ ID NO: 176 (HCDR1), SEQ ID NO: 177 (HCDR2) and SEQ ID NO: 178 (HCDR3);

ix) SEQ ID NO: 190 (LCDR1), SEQ ID NO: 191 (LCDR2), SEQ ID NO: 192 (LCDR3), SEQ ID NO: 196 (HCDR1), SEQ ID NO: 197 (HCDR2) and SEQ ID NO: 198 (HCDR3);

x) SEQ ID NO: 210 (LCDR1), SEQ ID NO: 211 (LCDR2), SEQ ID NO: 212 (LCDR3), SEQ ID NO: 216 (HCDR1), SEQ ID NO: 217 (HCDR2) and SEQ ID NO: 218 (HCDR3);

xi) SEQ ID NO: 230 (LCDR1), SEQ ID NO: 231 (LCDR2), SEQ ID NO: 232 (LCDR3), SEQ ID NO: 236 (HCDR1), SEQ ID NO: 237 (HCDR2) and SEQ ID NO: 238 (HCDR3);

xii) SEQ ID NO: 250 (LCDR1), SEQ ID NO: 251 (LCDR2), SEQ ID NO: 252 (LCDR3), SEQ ID NO: 256 (HCDR1), SEQ ID NO: 257 (HCDR2) and SEQ ID NO: 258 (HCDR3);

xiii) SEQ ID NO: 270 (LCDR1), SEQ ID NO: 271 (LCDR2), SEQ ID NO: 272 (LCDR3), SEQ ID NO: 276 (HCDR1), SEQ ID NO: 277 (HCDR2) and SEQ ID NO: 278 (HCDR3);

xiv) SEQ ID NO: 290 (LCDR1), SEQ ID NO: 291 (LCDR2), SEQ ID NO: 292 (LCDR3), SEQ ID NO: 296 (HCDR1), SEQ ID NO: 297 (HCDR2) and SEQ ID NO: 298 (HCDR3); and xv) SEQ ID NO: 2190 (LCDR1), SEQ ID NO: 2191 (LCDR2), SEQ ID NO: 2192 (LCDR3), SEQ ID NO: 2196 (HCDR1), SEQ ID NO: 2197 (HCDR2) and SEQ ID NO: 2198 (HCDR3).

In various embodiments, the anti-TREM-1 antigen-binding protein or anti-TREM1 antigen-binding portion of an antigen binding protein comprises a set of CDR sequences selected from:

i) SEQ ID NO: 30 (LCDR1), SEQ ID NO: 31 (LCDR2), SEQ ID NO: 32 (LCDR3), SEQ ID NO: 36 (HCDR1), SEQ ID NO: 37 (HCDR2) and SEQ ID NO: 38 (HCDR3);

ii) SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3);

iii) SEQ ID NO: 70 (LCDR1), SEQ ID NO: 71 (LCDR2), SEQ ID NO: 72 (LCDR3), SEQ ID NO: 76 (HCDR1), SEQ ID NO: 77 (HCDR2) and SEQ ID NO: 78 (HCDR3);

20 iv) SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) and SEQ ID NO: 118 (HCDR3);

v) SEQ ID NO: 150 (LCDR1), SEQ ID NO: 151 (LCDR2), SEQ ID NO: 152 (LCDR3), SEQ ID NO: 156 (HCDR1), SEQ ID NO: 157 (HCDR2) and SEQ ID NO: 158 (HCDR3);

vi) SEQ ID NO: 170 (LCDR1), SEQ ID NO: 171 (LCDR2), SEQ ID NO: 172 (LCDR3), SEQ ID NO: 176 (HCDR1), SEQ ID NO: 177 (HCDR2) and SEQ ID NO: 178 (HCDR3); and vii) SEQ ID NO: 290 (LCDR1), SEQ ID NO: 291 (LCDR2), SEQ ID NO: 292 (LCDR3), SEQ ID NO: 296 (HCDR1), SEQ ID NO: 297 (HCDR2) and SEQ ID NO: 298 (HCDR3).

In various embodiments, the anti-TREM-1 antigen-binding protein or anti-TREM1 antigen-binding portion of an antigen binding protein comprises a set of CDR sequences selected from: SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3); and SEQ ID NO: 150 (LCDR1), SEQ ID NO: 151 (LCDR2), SEQ ID NO: 152 (LCDR3), SEQ ID NO: 156 (HCDR1), SEQ ID NO: 157 (HCDR2) and SEQ ID NO: 158 (HCDR3).

In various embodiments, the anti-TREM-1 antigen-binding protein or anti-TREM1 antigen-binding portion of an antigen binding protein comprises:

a. a light chain variable domain comprising an amino acid sequence selected from the group consisting of:
   i. a sequence at least 80% identical to an amino acid sequence selected from SEQ ID NOS: 41, 61, 81, 101, 121, 141, 161, 181, 201, 221, 241, 261, 281, 301 and 2185;
   ii. a sequence encoded by a polynucleotide sequence that is at least 80% identical to a nucleic acid sequence selected from SEQ ID NOS: 39, 59, 79, 99, 119, 139, 159, 179, 199, 219, 239, 259, 279 299 and 2183;
   iii. a sequence encoded by a polynucleotide that hybridizes under moderately stringent conditions to the complement of a polynucleotide consisting of a nucleic acid sequence selected from SEQ ID NOS: 39, 59, 79, 99, 119, 139, 159, 179, 199, 219, 239, 259, 279, 299 and 2183; and
b. a heavy chain variable domain comprising an amino acid sequence selected from the group consisting of:
   i. a sequence that is at least 80% identical to an amino acid sequence selected from SEQ ID NOS: 42, 62, 82, 102. 122, 142, 162, 182, 202, 222, 242, 262, 282, 302 and 2186;
   ii. a sequence encoded by a polynucleotide sequence that is at least 80% identical to an amino acid sequence selected from SEQ ID NOS: 40, 60, 80, 100, 120, 140, 160, 180, 200, 220, 240, 260, 280, 300 and 2184;
   iii. a sequence encoded by a polynucleotide that hybridizes under moderately stringent conditions to the complement of a polynucleotide consisting of a nucleic sequence selected from SEQ ID NOS: 40, 60, 80, 100, 120, 140, 160, 180, 200, 220, 240, 260, 280 300 and 2184.

In various embodiments, the anti-TREM-1 antigen-binding protein or anti-TREM1 antigen-binding portion of an antigen binding protein comprises:

a. a light chain variable domain comprising an amino acid sequence selected from the group consisting of:

i. a sequence at least 80% identical to an amino acid sequence selected from SEQ ID NOS: 41, 61, 81, 121, 161, 181, and 301;

ii. a sequence encoded by a polynucleotide sequence that is at least 80% identical to a nucleic acid sequence selected from SEQ ID NOS: 39, 59, 79, 119, 159, 179, and 299;

iii. a sequence encoded by a polynucleotide that hybridizes under moderately stringent conditions to the complement of a polynucleotide consisting of a nucleic acid sequence selected from SEQ ID NOS: 39, 59, 79, 119, 159, 179, and 299; and b. a heavy chain variable domain comprising an amino acid sequence selected from the group consisting of:

i. a sequence that is at least 80% identical to an amino acid sequence selected from SEQ ID NOS: 42, 62, 82, 122, 162, 182, and 302;

ii. a sequence encoded by a polynucleotide sequence that is at least 80% identical to an amino acid sequence selected from SEQ ID NOS: 40, 60, 80, 120, 160, 180, and 300;

iii. a sequence encoded by a polynucleotide that hybridizes under moderately stringent conditions to the complement of a polynucleotide consisting of a nucleic sequence selected from SEQ ID NOS: 40, 60, 80, 120, 160, 180, and 300.

In various embodiments of the antigen binding protein, the anti-TREM-1 antigen-binding moiety comprises:

a. a light chain variable domain comprising an amino acid sequence selected from the group consisting of:

i. a sequence at least 80% identical to an amino acid sequence selected from SEQ ID NOS: 61 and 121;

ii. a sequence encoded by a polynucleotide sequence that is at least 80% identical to a nucleic acid sequence selected from SEQ ID NOS: 59 and 119;

iii. a sequence encoded by a polynucleotide that hybridizes under moderately stringent conditions to the complement of a polynucleotide consisting of a nucleic acid sequence selected from SEQ ID NOS: 59 and 119; and b. a heavy chain variable domain comprising an amino acid sequence selected from the group consisting of:

i. a sequence that is at least 80% identical to an amino acid sequence selected from SEQ ID NOS: 62 and 122;

ii. a sequence encoded by a polynucleotide sequence that is at least 80% identical to an amino acid sequence selected from SEQ ID NOS: 60 and 120;

iii. a sequence encoded by a polynucleotide that hybridizes under moderately stringent conditions to the complement of a polynucleotide consisting of a nucleic sequence selected from SEQ ID NOS: 60 and 120.

In various embodiments, the amino acid sequences can be 80%, 85%, 90%, 91%, 92%, 93%, 94%, 95%, 96%, 97%, 98% or 99% identical to SEQ ID NOs: 41, 61, 81, 101, 121, 141, 161, 181, 201, 221, 241, 261, 281, 301 and 2185 and SEQ ID NOS: 42, 62, 82, 102. 122, 142, 162, 182, 202, 222, 242, 262, 282, 302 and 2186.

In various embodiments of the antigen binding protein, the antigen binding moiety comprises an amino acid sequence at least 90% identical to a heavy chain variable region amino acid sequence selected from SEQ ID NOS: 42, 62, 82, 102. 122, 142, 162, 182, 202, 222, 242, 262, 282, 302 and 2186.

In various embodiments of the antigen binding protein, the antigen-binding moiety comprises an amino acid sequence at least 90% identical to a light chain variable region amino acid sequence selected from SEQ ID NOS: 41, 61, 81, 101, 121, 141, 161, 181, 201, 221, 241, 261, 281, 301 and 2185.

In various embodiments, the anti-TREM-1 antigen-binding protein or anti-TREM1 antigen-binding portion of an antigen binding protein comprises:

i) a light chain variable domain set out in SEQ ID NO: 41 and a heavy chain variable domain set out in SEQ ID NO: 42;

ii) a light chain variable domain set out in SEQ ID NO: 61 and a heavy chain variable domain set out in SEQ ID NO: 62;

iii) a light chain variable domain set out in SEQ ID NO: 81 and a heavy chain variable domain set out in SEQ ID NO: 82;

iv) a light chain variable domain set out in SEQ ID NO: 101 and a heavy chain variable domain set out in SEQ ID NO: 102;

v) a light chain variable domain set out in SEQ ID NO: 121 and a heavy chain variable domain set out in SEQ ID NO: 122;

vi) a light chain variable domain set out in SEQ ID NO: 141 and a heavy chain variable domain set out in SEQ ID NO: 142;

vii) a light chain variable domain set out in SEQ ID NO: 161 and a heavy chain variable domain set out in SEQ ID NO: 162;

viii) a light chain variable domain set out in SEQ ID NO: 181 and a heavy chain variable domain set out in SEQ ID NO: 182;

ix) a light chain variable domain set out in SEQ ID NO: 201 and a heavy chain variable domain set out in SEQ ID NO: 202;

x) a light chain variable domain set out in SEQ ID NO: 221 and a heavy chain variable domain set out in SEQ ID NO: 222;

xi) a light chain variable domain set out in SEQ ID NO: 241 and a heavy chain variable domain set out in SEQ ID NO: 242;

xii) a light chain variable domain set out in SEQ ID NO: 261 and a heavy chain variable domain set out in SEQ ID NO: 262;

xiii) a light chain variable domain set out in SEQ ID NO: 281 and a heavy chain variable domain set out in SEQ ID NO: 282;

xiv) a light chain variable domain set out in SEQ ID NO: 301 and a heavy chain variable domain set out in SEQ ID NO: 302; or xv) a light chain variable domain set out in SEQ ID NO: 2185 and a heavy chain variable domain set out in SEQ ID NO: 2186.

In various embodiments, the anti-TREM-1 antigen-binding protein or anti-TREM1 antigen-binding portion of an antigen binding protein comprises:

i) a light chain variable domain set out in SEQ ID NO: 41 and a heavy chain variable domain set out in SEQ ID NO: 42;

ii) a light chain variable domain set out in SEQ ID NO: 61 and a heavy chain variable domain set out in SEQ ID NO: 62;

iii) a light chain variable domain set out in SEQ ID NO: 81 and a heavy chain variable domain set out in SEQ ID NO: 82;

iv) a light chain variable domain set out in SEQ ID NO: 121 and a heavy chain variable domain set out in SEQ ID NO: 122;

v) a light chain variable domain set out in SEQ ID NO: 161 and a heavy chain variable domain set out in SEQ ID NO: 162;

vi) a light chain variable domain set out in SEQ ID NO: 181 and a heavy chain variable domain set out in SEQ ID NO: 182; or vii) a light chain variable domain set out in SEQ ID NO: 301 and a heavy chain variable domain set out in SEQ ID NO: 302.

In various embodiments, the anti-TREM-1 antigen-binding protein or anti-TREM1 antigen-binding portion of a antigen binding protein comprises: a light chain variable domain set out in SEQ ID NO: 61 and a heavy chain variable domain set out in SEQ ID NO: 62; or a light chain variable domain set out in SEQ ID NO: 121 and a heavy chain variable domain set out in SEQ ID NO: 122.

In various embodiments, the antigen binding protein has a light chain amino acid sequence set out in any one of SEQ ID NOS: 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, and 1086.

In various embodiments, the TREM-1 antibody or antigen binding protein has a light chain amino acid sequence set out in any one of SEQ ID NOS: 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, 2605.

In various embodiments, the TREM-1 antibody or antigen binding protein has a light chain amino acid sequence set out in any one of SEQ ID NO: 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, and 2357.

In various embodiments, the antigen binding protein has a heavy chain amino acid sequence set out in any one of SEQ ID NOS: 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1Q83, and 1085.

In various embodiments, the TREM-1 antibody or antigen binding protein has a heavy chain amino acid sequence set out in any one of SEQ ID NOS: 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, and 2007.

In various embodiments, the TREM-1 antibody or antigen binding protein has a heavy chain amino acid sequence set out in any one of SEQ ID NOS: 2011, 2013, 2015, 2017, 2019, 2021, 2026, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, and 2135.

In various embodiments, the antigen binding protein has a heavy chain amino acid sequence set out in any one of SEQ ID NOS: 2726-2776.

In various embodiments, the antigen binding protein has a heavy chain amino acid sequence set out in any one of SEQ ID NOS: 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1Q83, and 1085 and a corresponding light chain amino acid sequence set out in SEQ ID NOS: 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, and 1086.

In various embodiments, the TREM-1 antibody or antigen binding protein has a heavy chain amino acid sequence set out in any one of SEQ ID NOS: 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, and 2007 and a corresponding light chain amino acid sequence set out in SEQ ID NOS: 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, and 2605.

In various embodiments, the TREM-1 antibody or antigen binding protein has a heavy chain amino acid sequence set out in any one of SEQ ID NOS: 2011, 2013, 2015, 2017, 2019, 2021, 2026, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, and 2135 and a corresponding light chain amino acid sequence set out in SEQ ID NO: 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, and 2357.

In various embodiments, the antigen binding protein has the heavy and light chain pairs as set out in Table 10, Table 11, Table 13A, or Table 13B, or utilizes the heavy chain antigen binding protein set out in Table 16, Table 17 or Table 22.

Nucleic acid sequences of certain antigen binding protein heavy and light chains are set out in SEQ ID NOS: 303 to 526 (bivalent) and SEQ ID NOS: 527 to 862 (monovalent). Nucleic acid sequences of TREM-1 variant antibody heavy chain variable regions are set out in SEQ ID NOS: 1884, 1886, 1888, 1890, 1892, 1894, 1896, 1898, 1900, 1902, 1904, 1906, 1908, 1910, 1912, 1914, 1916, 1918, 1920, 1922, 1924, 1926, 1928, 1930, 1932, 1934, 1936, 1938, 1940, 1942, 1944, 1946, 1948, 1950, 1952, 1954, 1956, 1958, 1960, 1962, 1964, 1966, 1968, 1970, 1972, 1974, 1976, 1978, 1980, 1982, 1984, 1986, 1988, 1990, 1992, 1994, 1996, 1998, 2000, 2002, 2004, 2006, and 2008, and also set out in SEQ ID NOS: 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, and 2136; and TREM-1 variant antibody light chain variable regions nucleotide sequences are set out in SEQ ID NO: 2606, 2607, 2608, 2609, 2610, 2611, 2612, 2613, 2614, 2615, 2616, 2617, 2618, 2619, 2620, 2621, 2622, 2623, 2624, 2625, 2626, 2627, 2628, 2629, 2630, 2631, 2632, 2633, 2634, 2635, 2636, 2637, 2638, 2639, 2640, 2641, 2642, 2643, 2644, 2645, 2646, 2647, 2648, 2649, 2650, 2651, 2652, 2653, 2654, 2655, 2656, 2657, 2658, 2659, 2660, 2661, 2662, 2663, 2664, 2665, 2666, 2667, 2668, and also set out in SEQ ID NO: 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346, 2348, 2350, 2352, 2354, 2356, and 2358.

In various embodiments of the antigen binding proteins, one or more heavy chain framework amino acids of the anti-antigen-binding protein are replaced with corresponding amino acid(s) from another human antibody amino acid sequence. In various embodiments, one or more light chain framework amino acids of the antigen-binding protein are replaced with corresponding amino acid(s) from another human antibody amino acid sequence.

In various embodiments, the anti-TREM-1 antigen binding protein further comprises a human light chain constant region attached to said light chain variable region.

In various embodiments of the antigen binding protein: the antigen binding protein comprises two light chains and two heavy chains: each heavy chain comprises an IL-10 moiety attached at the C-terminus of the heavy chain; each heavy-chain-IL-10 moiety antigen binding protein comprises an amino acid sequence at least 90% identical to a sequence selected from SEQ ID NOS: 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1Q83, and 1085; and each light chain comprises an amino acid sequence at least 90% identical to a sequence selected from SEQ ID NOS: 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, and 1086.

In various embodiments, provided herein are variants of the TREM-1 antibody heavy chain and/or light chain variable regions. TREM-1 antibody heavy chain variable region variant sequences are set out in SEQ ID NO: 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2011, 2013, 2015, 2017, 2019, 2021, 2026, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, 2135, 2726-2776 and Table 10, Table 11, Table 13A, Table 13B and Table 22.

TREM-1 antibody light chain variable region variant sequences are set out in SEQ ID NOS: 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, 2605, 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, 2357, Table 10 and Table 11. It is contemplated that a TREM-1-IL-10 antigen binding protein comprises a TREM-1 antibody variant heavy chain and/or light chain sequence as disclosed herein.

In various embodiments, the antigen binding protein may be monovalent. In various embodiments the heavy-chain-IL-10 moiety antigen binding protein comprises an amino acid sequence at least 90% identical to a sequence selected from SEQ ID NOS: 1087, 1090, 1093, 1096, 1105, 1108, 1111, 1114, 1117, 1123, 1126, 1129, 1132, 1138, 1141, 1147, 1150, 1153, 1156, 1159, 1162, 1165, 1168, 1171, 1174, 1177, 1180, 1183, 1186, 1189, 1192, 1195, 1198, 1201, 1204, 1207, 1210, 1213, 1216, 1219, 1222, 1225, 1228, 1231, 1237, 1240, 1243, 1246, 1252, 1255, 1258, 1261, 1264, 1267, 1270, 1273, 1276, 1279, 1285, 1288, 1294, 1297, 1300, 1303, 1309, 1312, 1315, 1318, 1321, 1324, 1333, 1336, 1342, 1345, 1348, 1351, 1354, 1357, 1360, 1363, 1366, 1369, 1372, 1375, 1378, 1381, 1384, 1387, 1390, 1393, 1396, 1399, 1402, 1408, 1411, 1414, 1417, and 1420. In various embodiments, the light-chain comprises an amino acid sequence at least 90% identical to a sequence selected from SEQ ID NOS: 1088, 1091, 1094, 1097, 1106, 1109, 1112, 1115, 1118, 1124, 1127, 1130, 1133, 1139, 1142, 1148, 1151, 1154, 1157, 1160, 1163, 1166, 1169, 1172, 1175, 1178, 1181, 1184, 1187, 1190, 1193, 1196, 1199, 1202, 1205, 1208, 1211, 1214, 1217, 1220, 1223, 1226, 1229, 1232, 1238, 1241, 1244, 1247, 1253, 1256, 1259, 1262, 1265, 1268, 1271, 1274, 1277, 1280, 1286, 1289, 1295, 1298, 1301, 1304, 1310, 1313, 1316, 1319, 1322, 1325, 1334, 1337, 1343, 1346, 1349, 1352, 1355, 1358, 1361, 1364, 1367, 1370, 1373, 1376, 1379, 1382, 1385, 1388, 1391, 1394, 1397, 1400, 1403, 1409, 1412, 1415, 1418 and 1421. In various embodiments, the monovalent antigen binding protein further comprises an Fc region, e.g., as set out in SEQ ID NO: 1089, 1092, 1095, 1098, 1107, 1110, 1113, 1116, 1119, 1125, 1128, 1131, 1134, 1140, 1143, 1149, 1152, 1155, 1158, 1161, 1164, 1167, 1170, 1173, 1176, 1179, 1182, 1185, 1188, 1191, 1194, 1197, 1200, 1203, 1206, 1209, 1212, 1215, 1218, 1221, 1224, 1227, 1230, 1233, 1239, 1242, 1245, 1248, 1254, 1257, 1260, 1263, 1266, 1269, 1272, 1275, 1278, 1281, 1287, 1290, 1296, 1299, 1302, 1305, 1311, 1314, 1317, 1320, 1323, 1326, 1335, 1338, 1344, 1347, 1350, 1353, 1356, 1359, 1362, 1365, 1368, 1371, 1374, 1377, 1380, 1383, 1386, 1389, 1392, 1395, 1398, 1401, 1404, 1410, 1413, 1416, 1419 and 1422. The monovalent antigen binding proteins, and Fc region may be assembled or matched as set out in Table 13B.

In various embodiments of the antigen binding protein: the antigen binding protein comprises one or two light chains and one or two heavy chains: each heavy chain comprises an IL-10 moiety attached at the C-terminus of the heavy chain; each heavy-chain-IL-10 moiety antigen binding protein comprises an amino acid sequence at least 90% identical to a sequence selected from: SEQ ID NO: 2137, 2139, 2141, 2143, 2145, 2147, 2149, 2151, 2153, 2155, 2157, 2159, 2161, 2163, 2165, 2167, 2169, 2171, 2173, 2175, 2177, 2179, 2181, 2359, 2361, 2363, 2365, 2367, 2369, 2371, 2373, 2375, 2377, 2379, 2381, 2383, 2385, 2387, 2389, 2391, 2393, 2395, 2397, 2399, 2401, 2403, 2405, 2407, 2409, 2411, 2143, 2415, 2417, 2419, 2421, 2423, 2425, 2427, 2429, 2431, 2433, 2435, 2437, 2439, 2441, 2443, 2445, 2447, 2449, 2451, 2453, 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2498, 2499, 2501, 2503, 2505, 2507, 2509, 2511, 2513, 2515, 2517, 2519, 2521, 2523, 2525, 2527, 2529, 2531, 2533, 2535, 2537, 2539, and 2726-2776, and as set out in Table 16 or Table 17 or Table 21 or Table 22.

In various embodiments, the antigen binding protein comprises an amino acid sequence selected from: SEQ ID NOS: 2137, 2139, 2141, 2143, 2145, 2147, 2149, 2151, 2153, 2155, 2157, 2159, 2161, 2163, 2165, 2167, 2169, 2171, 2173, 2175, 2177, 2179, 2181, 2359, 2361, 2363, 2365, 2367, 2369, 2371, 2373, 2375, 2377, 2379, 2381, 2383, 2385, 2387, 2389, 2391, 2393, 2395, 2397, 2399, 2401, 2403, 2405, 2407, 2409, 2411, 2143, 2415, 2417, 2419, 2421, 2423, 2425, 2427, 2429, 2431, 2433, 2435, 2437, 2439, 2441, 2443, 2445, 2447, 2449, 2451, 2453, 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2498, 2499, 2501, 2503, 2505, 2507, 2509, 2511, 2513, 2515, 2517, 2519, 2521, 2523, 2525, 2527, 2529, 2531, 2533, 2535, 2537, and 2539. In various embodiments, the heavy chain portion of the antigen binding protein pairs with a corresponding light chain clone, e.g., antibody 611B12 (SEQ ID NO: 105, but lacking the signal sequence or SEQ ID NO: 2552, TREM1_61B12.001_huIgGz SEFL2 light chain, or SEQ ID NO: 1042, 1044, 1046, 1048, 1052, 1054), or as set out in SEQ ID NO: 2233 to 2358, Table 10 or Table 11.

In various embodiments, the antigen binding protein has a heavy chain amino acid sequence at least 90% identical to a sequence set out in any one of SEQ ID NOS: 2726-2776. In various embodiments, the antigen binding protein has a heavy chain amino acid sequence set out in any one of SEQ ID NOS: 2726-2776. In various embodiments, the antigen binding protein has a heavy chain amino acid sequence set out in any one of SEQ ID NOS: 2727-2732. In various embodiments, the heavy chain pairs with a corresponding light chain clone, e.g., SEQ ID NO: 976 or SEQ ID NO: 2554 for clone 63F8.001 (but lacking the signal sequence), and SEQ ID NO: 992 or SEQ ID NO: 2555 for 64D7.001 (but lacking the signal sequence). In various embodiments, the antigen binding protein comprises the heavy chain amino acid sequence of SEQ ID NO: 2727 or 2728, and the light chain amino acid sequence set out in SEQ ID NO: 976 or SEQ ID NO: 2554, or other light chain sequence for clone 63F8 or 63F8.001 as described herein. In various embodiments, the antigen binding protein comprises the heavy chain amino acid sequence of SEQ ID NO: 2729, 2730, 2731 or 2732, and the light chain amino acid sequence set out in and SEQ ID NO: 992 or SEQ ID NO: 2555 or other light chain sequence for 64D7 or 64D7.001 as described herein.

In various embodiments of the antigen binding protein, the antigen-binding moiety inhibits TREM-1 ligand(s) binding to TREM-1.

In various embodiments, the antigen binding protein comprises an antigen-binding moiety and one or two IL-10 mutein moieties wherein:
  a. the antigen-binding moiety is an antibody or antibody fragment,
  b. each IL-10 moiety is independently monovalent or bivalent,
  c. each IL-10 moiety is independently selected from and one or more human IL-10 muteins having sequences that are 90% identical to SEQ ID NO: 2,
  d. at least one IL-10 moiety is covalently bound to the antigen-binding moiety, and
  e. the antigen-binding moiety competes for binding to a human TREM-1 protein with the anti-TREM-1 antigen binding moiety described herein.

In various embodiments of the antigen binding protein, the antigen-binding moiety is a human antibody.

Also provided is an isolated nucleic acid molecule comprising a nucleotide sequence that encodes the heavy chain region of the antigen binding protein of as described herein, an isolated nucleic acid molecule comprising a nucleotide sequence that encodes the light chain region of the antigen binding protein of as described herein, and an isolated nucleic acid molecule comprising a nucleotide sequence that encodes the heavy chain region of the antigen binding protein and further comprising a nucleotide sequence that encodes the light chain region of the antigen binding protein as described herein.

The disclosure provides an expression vector or vectors comprising the nucleic acid molecule or molecules encoding a antigen binding protein as described herein operably linked to an expression control sequence.

Also contemplated is a recombinant host cell comprising the nucleic acid molecule comprising an antigen binding protein as described herein, or the vector comprising said nucleic acid. In various embodiments, the host cell is a mammalian cell. In various embodiments, the host cell is a CHO cell. The disclosure provides a method of using the host cell described herein to produce an antigen binding protein, comprising culturing the host cell and recovering said antibody, and provides an antigen binding protein produced by the method.

The disclosure contemplates a pharmaceutical composition comprising the antigen binding protein as described herein and a pharmaceutically acceptable carrier. Also provided is a pharmaceutical composition comprising an IL-10 mutein of this disclosure. Further provided is a pharmaceutical composition comprising an anti-TREM-1 antibody or antibody fragment of this disclosure. It is contemplated that the pharmaceutical compositions are sterile pharmaceutical compositions.

In one aspect, the disclosure provides a method of treating an inflammatory disease in a subject in a need thereof comprising administering an IL-10 mutein as described herein or a composition comprising an IL-10 mutein.

In a related aspect, the disclosure provides a method of treating an inflammatory disease in a subject in a need thereof comprising administering an anti-TREM-1 antigen-binding protein as described herein or a composition comprising an anti-TREM-1 antigen binding protein as described herein. In various embodiments, the method further comprises administering an anti-IL-10 mutein as described herein in combination with an anti-TREM-1 antigen binding protein. In various embodiments, the anti-TREM-1 antigen-binding protein and the IL-10 mutein are administered in the same composition or in different compositions.

Also provided is a method of treating an inflammatory disease in a subject in a need thereof comprising administering a antigen binding protein as described herein or a composition of comprising an antigen binding protein as described herein. In various embodiments, provided is a method of treating an inflammatory disease in a subject in a need thereof comprising administering an anti-TREM-1/IL-10 mutein antigen binding protein as described herein or a composition of comprising said antigen binding protein.

In various embodiments, the inflammatory disease is selected from the group consisting of inflammatory bowel disease, ulcerative colitis, Crohn's disease, irritable bowel syndrome, rheumatoid arthritis, psoriasis, psoriatic arthritis, or cytokine release syndrome (CRS). In one embodiment, the inflammatory disease is inflammatory bowel disease. In one embodiment, the inflammatory disease is ulcerative colitis. In one embodiment, the inflammatory disease is Crohn's disease. In one embodiment, the inflammatory disease is irritable bowel syndrome. In one embodiment, the inflammatory disease is rheumatoid arthritis. In one embodiment, the inflammatory disease is psoriasis. In one embodiment, the inflammatory disease is psoriatic arthritis. In one embodiment, the inflammatory disease is cytokine release syndrome.

In various embodiments, treatment with the IL-10 mutein reduces the suppression of TNF-alpha production in myeloid cells, reduces levels of CD8+ T cell stimulation, and/or reduces the level of B cell stimulation compared to wt IL-10. In various embodiments, treatment with the IL-10 mutein antigen binding protein, for example an anti-TREM-1/IL-10 mutein antigen binding protein, suppresses TNF-α production in myeloid cells. In various embodiments, treatment with IL-10 mutein antigen binding protein, for example an anti-TREM-1/IL-10 mutein antigen binding protein, suppresses TNF-α production in myeloid cells, while reducing CD8+ T cell and B cell activation. In various embodiments, the treatment inhibits TNF-α production in myeloid cells, without CD8+ T cell stimulation and/or B cell stimulation in the subject. In various embodiments, the treatment reduces the levels of TNF-α in the subject.

In various embodiments, the treatment is administered intravenously or subcutaneously. In various embodiments, the treatment is administered once weekly, once every two weeks, once every three weeks, once every 4 weeks, once monthly, once every 3 months, or once every six months.

In various embodiments, the methods comprise administering one or two additional therapeutic agents. In various embodiments, the additional therapeutic agents are selected from corticosteroids, NSAIDs, analgesics, immunosuppressive agents, anti-inflammatory agents, TNFα inhibitors, IL-12/IL-23 inhibitors, IL-17 and IFN-γ.

The disclosure also provides a composition comprising an IL-10 mutein as described herein for use in treating an inflammatory disease. In certain embodiments, the disclosure provides use of a composition comprising an IL-10 mutein as described herein in the preparation of a medicament for treating an inflammatory disease.

Further contemplated is a composition comprising an anti-TREM-1 antibody or antigen-binding fragment as described herein for use in treating an inflammatory disease. In certain embodiments, the disclosure provides use of a composition comprising an anti-TREM-1 antibody or antigen-binding fragment thereof as described herein in the preparation of a medicament for treating an inflammatory disease.

Also contemplated is a composition comprising an anti-TREM-1 antibody or antigen-binding fragment of as described herein in combination with an anti-IL-10 mutein as described herein for use in treating an inflammatory disease. In various embodiments, the disclosure provides use of composition comprising an anti-TREM-1 antibody or antigen-binding fragment as described herein in combination with an anti-IL-10 mutein as described herein in preparation of a medicament for treating an inflammatory disease.

Also contemplated is a composition comprising an antigen binding protein, for example an anti-TREM-1/IL-10 mutein antigen binding protein, as described herein for use in treating an inflammatory disease. Further contemplated is use of a composition comprising an antigen binding protein as described herein, for example an anti-TREM-1/IL-10 mutein antigen binding protein, in the preparation of a medicament for treating an inflammatory disease.

In various embodiments, the inflammatory disease is inflammatory bowel disease, ulcerative colitis, Crohn's disease, irritable bowel syndrome, rheumatoid arthritis, psoriasis, psoriatic arthritis, or cytokine release syndrome (CRS). In one embodiment, the inflammatory disease is ulcerative colitis. In one embodiment, the inflammatory disease is Crohn's disease.

In one embodiment, the inflammatory disease is irritable bowel syndrome. In one embodiment, the inflammatory disease is rheumatoid arthritis. In one embodiment, the inflammatory disease is psoriasis. In one embodiment, the inflammatory disease is psoriatic arthritis. In one embodiment, the inflammatory disease is cytokine release syndrome.

It is understood that each feature or embodiment, or combination, described herein is a non-limiting, illustrative example of any of the aspects of the invention and, as such, is meant to be combinable with any other feature or embodiment, or combination, described herein. For example, where features are described with language such as "one embodiment", "some embodiments", "certain embodiments", "further embodiment", "specific exemplary embodiments", and/or "another embodiment", each of these types of embodiments is a non-limiting example of a feature that is intended to be combined with any other feature, or combination of features, described herein without having to list every possible combination. Such features or combinations of features apply to any of the aspects of the invention. Where examples of values falling within ranges are disclosed, any of these examples are contemplated as possible endpoints of a range, any and all numeric values between such endpoints are contemplated, and any and all combinations of upper and lower endpoints are envisioned.

The headings herein are for the convenience of the reader and not intended to be limiting. Additional aspects, embodiments, and variations of the invention will be apparent from the Detailed Description and/or Drawing and/or claims.

BRIEF DESCRIPTION OF THE DRAWINGS

FIG. 1D illustrates the location of the IL-10 mutein attachment to the antigen binding protein.

FIGS. 5A-5B show IL-10 mutein potency on human (FIG. 5A) or mouse (FIG. 5B) monocytes, as demonstrated by TNF levels, is improved through TREM-1 binding of the fusion protein compared to antibody or IL-10 mutein alone.

DETAILED DESCRIPTION

Figure 1A:
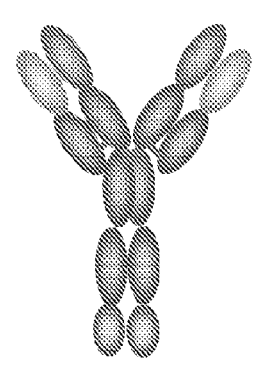
FIGS. 1A-1C show exemplary schematic drawings of bivalent and monovalent anti-TREM1 mAb/IL-10 mutein antigen binding proteins.
Figure 1B:
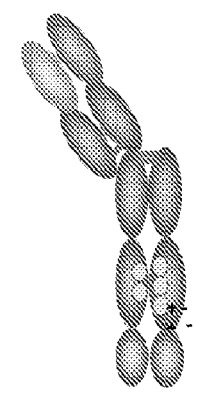
Figure 1C:
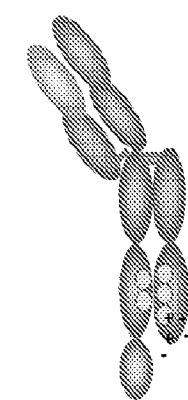

The present disclosure provides IL-10 muteins and antigen binding proteins comprising IL-10 muteins. Antigen binding proteins/fusion proteins in accordance with this disclosure show improved targeting to immune cells and modulation of cellular activity and cytokine response useful to treat inflammatory diseases, such as inflammatory bowel disease, Crohn's disease, ulcerative colitis or rheumatoid arthritis. Therefore, targeting IL-10 inhibitory activity on myeloid cells could provide effective treatment for inflammatory bowel disease (IBD) without eliciting side effects. An IL-10 mutein antigen binding protein contemplated herein comprises an antigen binding moiety that can target the IL-10 mutein to inflammatory cells. Suitable antigen binding moieties include anti-TREM-1 antibodies and anti-PD-1 antibodies.

Definitions

The term "polypeptide binding agent" or "antigen binding protein" refers to a polypeptide that is capable of specifically binding an antigen, e.g. a target or its signaling partner, or that is capable of binding an antigen with a measurable binding affinity. Examples of polypeptide binding agents include antibodies, peptibodies, polypeptides and peptides, optionally conjugated to other peptide moieties or non-peptidic moieties. Antigens to which a polypeptide binding agent may bind include any proteinaceous or non-proteinaceous molecule that is capable of eliciting an antibody response, or that is capable of binding to a polypeptide binding agent with detectable binding affinity greater than non-specific binding. The antigen to which a modulating polypeptide binding agent binds may include a target, a signaling partner of a target, and/or a complex comprising the target and its signaling partner. Antigen binding proteins as contemplated herein may further comprise a portion of another polypeptide, e.g., a heterologous moiety as part of a fusion protein. In this instance the antigen binding protein may comprise an IL-10 mutein and an antigen binding moiety, such as an antibody or antigen binding fragment thereof, fused to, linked to, or in sequence with the antigen binding moiety or fragment thereof.

The term "antibody" is used in the broadest sense and includes fully assembled antibodies, tetrameric antibodies, monoclonal antibodies, polyclonal antibodies, multispecific antibodies (e.g., bispecific antibodies), antibody fragments that can bind an antigen (e.g., Fab', F'(ab)2, Fv, single chain antibodies, diabodies), and recombinant peptides comprising the forgoing as long as they exhibit the desired biological activity. An "immunoglobulin" or "tetrameric antibody" is a tetrameric glycoprotein that consists of two heavy chains and two light chains, each comprising a variable region and a constant region. Antigen-binding portions may be produced by recombinant DNA techniques or by enzymatic or chemical cleavage of intact antibodies. Antibody fragments or antigen-binding portions include, inter alia, Fab, Fab', F(ab')2, Fv, domain antibody (dAb), complementarity determining region (CDR) fragments, CDR-grafted antibodies, single-chain antibodies (scFv), single chain antibody fragments, chimeric antibodies, diabodies, triabodies, tetrabodies, minibody, linear antibody; chelating recombinant antibody, a tribody or bibody, an intrabody, a nanobody, a small modular immunopharmaceutical (SMIP), an antigen-binding-domain immunoglobulin fusion protein, a camelized antibody, a VHH containing antibody, or a variant or a derivative thereof, and polypeptides that contain at least a portion of an immunoglobulin that is sufficient to confer specific antigen binding to the polypeptide, such as one, two, three, four, five or six CDR sequences, as long as the antibody retains the desired biological activity.

The term "monovalent IgG" as used herein refers to an IgG in which a single antigen-binding fragment (Fab) is fused to a complete constant domain fragment (Fc) engineered to heterodimerize through mutations in the $C_H3$ domain within the Fc. A monovalent IgG is also known as a "one armed" antibody.

"Monoclonal antibody" refers to an antibody obtained from a population of substantially homogeneous antibodies, i.e., the individual antibodies comprising the population are identical except for possible naturally occurring mutations that may be present in minor amounts.

"Antibody variant" as used herein refers to an antibody polypeptide sequence that contains at least one amino acid substitution, deletion, or insertion in the variable region of the natural antibody variable region domains. Variants may be substantially homologous or substantially identical to the unmodified antibody.

An "isolated" antibody is one that has been identified and separated and recovered from a component of its natural environment. Contaminant components of its natural environment are materials that would interfere with diagnostic or therapeutic uses for the antibody, and may include enzymes, hormones, and other proteinaceous or non-proteinaceous solutes. In preferred embodiments, the antibody will be purified (1) to greater than 95% by weight of antibody as determined by the Lowry method, and most preferably more than 99% by weight, (2) to a degree sufficient to obtain at least 15 residues of N-terminal or internal amino acid sequence by use of a spinning cup sequenator, or (3) to homogeneity by SDS-PAGE under reducing or nonreducing conditions using Coomassie blue or, preferably, silver stain, or HPLC methods. Isolated antibody includes the antibody in situ within recombinant cells since at least one component of the antibody's natural environment will not be present. Ordinarily, however, isolated antibody will be prepared by at least one purification step.

"Heavy chain variable region" as used herein refers to the region of the antibody molecule comprising at least one complementarity determining region (CDR) of said antibody heavy chain variable domain. The heavy chain variable region may contain one, two, or three CDR of said antibody heavy chain.

"Light chain variable region" as used herein refers to the region of an antibody molecule, comprising at least one complementarity determining region (CDR) of said antibody light chain variable domain. The light chain variable region may contain one, two, or three CDR of said antibody light chain, which may be either a kappa or lambda light chain depending on the antibody.

As used herein, an antibody that "specifically binds" is "antigen specific", is "specific for" antigen target or is "immunoreactive" with an antigen refers to an antibody or polypeptide binding agent of the invention that binds an antigen with greater affinity than other antigens of similar sequence. In one aspect, the antigen binding protein of the invention, or fragments, variants, or derivatives thereof, will bind with a greater affinity to human antigen as compared to its binding affinity to similar antigens of other, i.e., non-human, species, but polypeptide binding agents that recognize and bind orthologs of the target are within the scope of the invention.

The term "epitope" refers to that portion of any molecule capable of being recognized by and bound by a selective binding agent at one or more of the antigen binding regions. Epitopes usually consist of chemically active surface groupings of molecules, such as, amino acids or carbohydrate side chains, and have specific three-dimensional structural characteristics as well as specific charge characteristics. Epitopes as used herein may be contiguous or non-contiguous.

The term "derivative" when used in connection with polypeptide binding agents and polypeptides of the invention refers to polypeptides chemically modified by such techniques as ubiquitination, conjugation to therapeutic or diagnostic agents, labeling (e.g., with radionuclides or various enzymes), covalent polymer attachment such as PEGylation (derivatization with polyethylene glycol) and insertion or substitution by chemical synthesis of amino acids such as ornithine, which do not normally occur in human proteins. Derivatives retain the binding properties of underivatized molecules of the invention.

A "linker," as used herein, refers to a peptide that links two polypeptides. A linker can be from 1-80 amino acids in length. In some embodiments, a linker can be 2-40, 3-40, 3-30, or 3-20 amino acids long. In some embodiments, a linker can be a peptide of 18, 17, 16, 15, 14, 13, 12, 11, 10, 9, 8, 7, 6, 5, 4 or 3 amino acids long. In other embodiments, a linker can be 3-25, 3-18, 5-20, 6-18, or 10-20 amino acids long. In other embodiments, a linker can be about, 2, 3, 4, 5, 6, 7, 8, 9, 10, 11, 12, 13, 14, 15, 16, 17, 18, 19, 20, 21, 22, 23, 24, 25, 26, 27, 28, 29, or 30 amino acids long. In many cases, linkers lack free cysteine residues (i.e. and are therefore not involved in disulfide bonds) and also do not contain N-glycosylation sites (that is, Asn-Xxx-Ser/Thr, where X can be any amino acid except proline). In certain embodiments, peptide having the sequence G3SG2 (SEQ ID NO: 2676) or G4S (SEQ ID NO:2725) is a linker between an anti-TREM-1 antigen binding protein and an IL-10 mutein. Examples of other suitable linkers include G2, G3, G3S(SEQ ID NO:2705), G3P (SEQ ID NO: 2706), G3Q (SEQ ID NO:2707), and G5 (SEQ ID NO: 2705), among many others. Each capital letter in the foregoing linkers refers to the conventional one-letter code for an amino acid and each number refers to the number of tandem repeats of the amino acid in the linker. For example, "G3SG2 (SEQ ID NO: 2676)" refers to a linker having the sequence Gly-Gly-Gly-Ser-Gly-Gly (SEQ ID NO: 2676). "G4S" refers to a linker having the sequence Gly-Gly-Gly-Gly-Ser (SEQ ID NO: 2725).

A "therapeutically effective amount" of a drug used to treat a disease is an amount that can reduce the severity of a disease, reduce the severity of one or more symptoms associated with the disease or its treatment, or delay the onset of more serious symptoms or a more serious disease that can occur with some frequency following the treated condition.

"Treatment" of any disease mentioned herein encompasses an alleviation of at least one symptom of the disease, a reduction in the severity of the disease, or the delay or prevention of disease progression to more serious symptoms that may, in some cases, accompany the disease or lead to at least one other disease. Treatment need not mean that the disease is totally cured. A useful therapeutic agent needs only to reduce the severity of a disease, reduce the severity of one or more symptoms associated with the disease or its treatment, or delay the onset of more serious symptoms or a more serious disease that can occur with some frequency following the treated condition. For example, if the disease were an inflammatory bowel disease, a therapeutic agent used as a treatment may reduce the number of distinct sites of inflammation in the gut or the total extent of the gut affected. It may reduce pain and/or swelling, reduce symptoms such as diarrhea, constipation, or vomiting, and/or prevent perforation of the gut.

"Subject" encompasses mammals and non-mammals. Examples of mammals include, but are not limited to, any member of the mammalian class: humans, non-human primates such as chimpanzees, and other apes and monkey species; farm animals such as cattle, horses, sheep, goats, swine; domestic animals such as rabbits, dogs, and cats; laboratory animals including rodents, such as rats, mice and guinea pigs, and the like.

Examples of non-mammals include, but are not limited to, birds, fish, and the like. The term does not denote a particular age or gender.

"Myeloid cell" as used herein refers to subgroup of immune cells derived from blood progenitor cells of the myeloid lineage, and include granulocytes, monocytes, macrophages, dendritic cells (DCs). Myeloid cells serve an important function in protective immunity, often having phagocytic and antigen presenting cell (APC) functions. See e.g., de Kleer et al., *Front. Immunol.*, 5:423, 2014.

Interleukin-10

Interleukin-10 (IL-10) is an inflammatory cytokine that is involved in a variety of immunoregulation processes. IL-10 signals through a receptor complex consisting of two IL-10 receptor-1 (IL10R1) and two IL-10 receptor-2 (IL-10R2) proteins. The biologically active form of IL-10 is as a homodimer that binds to IL-10R1/IL-10R2 and signals through the Jak1/Tyk2 and stat3 pathways. IL-10 has a higher affinity for IL-10R1 compared to IL-10R2. IL-10 is expressed as a 178-amino-acid protein comprising an 18 amino acid signal peptide. The IL-10 homodimer secondary structure exhibits a helix-turn-helix domain swap comprised of 6 α-helices in each domain, A, B, C, D, E and F helices. The nucleotide and amino acid sequence of human IL-10 are set out in SEQ ID NO: 1 and SEQ ID NO: 2, respectively. SEQ ID NO: 2 refers to mature human IL-10 lacking the signal sequence.

Human IL-10 (hIL-10) and Epstein Barr virus IL-10 (vIL-10) share ~83% sequence identity and similar secondary structure. vIL-10 suppresses inflammatory cytokine production and inhibits MHC II expression in macrophages and prevents T cell proliferation. vIL-10 does not co-stimulate thymocyte and mast cell proliferation and does not induce B cell MHC class II expression and has a lower affinity for cell surface IL-10R1. Ala87 (Ile in human) is a key residue involved in the reduced immunostimulatory activity of vIL-10.

Human IL-10 and IL-10 in cynomolgus monkey (cyno IL-10) share approximately 96% sequence identity while human and cyno IL-10R1 share approximately 93% sequence identity. There is a 4 amino acid difference at the binding interface between human and cyno IL-10R1. I45T and E46G is on the loop that interacts with IL-10's AB loop, although interaction is primarily main chain. A189T and S192T are on the loop that interacts with helix A but with no direct interaction with IL-10. In IL-10, there is a 2 amino acid differences near the IL-10R1 binding interface for human and cyno IL-10, N21 and L46 in human are both adjacent to the IL-10/IL-10R1 interaction surface.

Previous studies have shown that IL-10 inhibition of myeloid cells is sufficient for the treatment of inflammatory bowel disease (IBD). However, clinical efficacy of IL-10 has been hampered by dose limiting toxicity. To circumvent this issue, provided herein are muteins of IL-10 designed to have decreased activity to minimize systemic adverse side effects but still retain immunosuppressive properties for the treatment of IBD. Treatment with an IL-10 mutein with attenuated activity could alleviate some of the immunostimulatory effects of the cytokine. To address a possible decrease in the preferred immunosuppressive effects, the IL-10 muteins are fused to a targeting moiety (e.g., an antibody) to increase local concentration in monocytes, regulatory T cells, and CD4+ T cells.

Muteins of IL-10 were targeted in different sections of the IL-10 protein, including Site 1a which interacts with IL-10R1 in the helix A, helix F and AB loop and Site Ib which interacts with IL-10R1 in helix A, helix F, AB loop, helix B, helix C, CD loop, and helix E. Muteins include changes at one or more of the following residues: Site Ia (Helix A), K34, T35, Q38; Site Ia (Helix F), I136, Y137, K138, S141, E142, D144, I145; Site Ib (Helix A), H14, F15, M22, P20, L23, R24, R27, D28; Site Ib (F), E151, M154, M156, K157, N160; Site Ia (AB loop), M39, K40, D41, Q42, L43, D44, N45, L46, L47, L48, K49; helix B, F56, K57, Y59; helix C, L60, E67, Q70, M77, M79; CD loop, N82, Q83, D84, P85, D86, I87; helix D, A89, H90, S93, T100, L103, H109, R110, L112, E115, N116; or helix E, A127, K130.

Amino acid sequences of certain IL-10 muteins are set out in SEQ ID NO: 3-10, and SEQ ID NOS: 2138, 2140, 2142, 2144, 2146, 2148, 2150, 2152, 2154, 2156, 2158, 2160, 2162, 2164, 2166, 2168, 2170 2172, 2174, 2176, 2178, 2180, 2182, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2500, 2502, 2504, 2506, 2508, 2510, 2512, 2514, 2516, 2518, 2520, 2522, 2524, 2526, 2528, 2530, 2532, 2534, 2536, 2538, 2540, and 2777-2791, and Table 1, Table 16, Table 17 and Table 21.

IL-10 muteins and antigen binding proteins described herein may be screened for binding affinity by methods known in the art. For example, gel-shift assays, Western blots, radiolabeled competition assay, co-fractionation by chromatography, co-precipitation, cross linking, ELISA, surface plasmon resonance (SPR), KinExA and the like may be used, which are described in, for example, *Current Protocols in Molecular Biology* (1999) John Wiley & Sons, NY, which is incorporated herein by reference in its entirety.

The IL-10 muteins of the present disclosure preferably have reduced potency compared to wt IL-10 activity. In various embodiments, the IL-10 mutein has about 10-fold to about 5000-fold reduced potency compared to wt IL-10. In various embodiments, the IL-10 muteins have about 10- to 1000-fold less potency, about 50- to 500-fold less potency, about 100- to 500-fold or more reduced potency. In various embodiments, the potency is measured in an LPS stimulation assay. In some embodiments, the assay readout is LPS-induced TNFα production in monocytes/myeloid cells.

Antigen Binding Proteins and Antibodies

Immunoglobulin variable domains exhibit the same general structure of relatively conserved framework regions (FR) joined by three hypervariable regions or CDRs. From N-terminus to C-terminus, both light and heavy chains comprise the domains FR1, CDR1, FR2, CDR2, FR3, CDR3 and FR4. The assignment of amino acids to each domain is in accordance with the definitions of Kabat Sequences of Proteins of Immunological Interest (National Institutes of Health, Bethesda, Md. (1987 and 1991)), or Chothia & Lesk, *J. Mol. Biol.* 196:901-917, 1987; Chothia et al., *Nature* 342:878-883, 1989.

The hypervariable region of an antibody refers to the CDR amino acid residues of an antibody which are responsible for antigen-binding. The hypervariable region comprises amino acid residues from a CDR [e.g., residues 24-34 (L1), 50-56 (L2) and 89-97 (L3) in the light chain variable domain and 31-35 (H1), 50-65 (H2) and 95-102 (H3) in the heavy chain variable domain as described by Kabat et al., *Sequences of Proteins of Immunological Interest,* 5th Ed. Public Health Service, National Institutes of Health, Bethesda, Md. (1991)] and/or those residues from a hypervariable loop (e.g., residues 26-32 (L1), 50-52 (L2) and 91-96 (L3) in the light chain variable domain and 26-32 (H1), 53-55 (H2) and 96-101 (H3) in the heavy chain variable domain as described by [Chothia et al., *J. Mol. Biol.* 196:901-917 (1987)]. CDRs have also been identified and numbered according to ImMunoGenTics (IMGT) numbering (Lefranc, M.-P., *The Immunologist,* 7, 132-136 (1999); Lefranc, M.-P. et al., *Dev. Comp. Immunol.,* 27, 55-77 (2003), which describes the CDR locations in the light and heavy chain variable domains as follows: CDR1, approximately residues 27 to 38; CDR2, approximately residues 56 to 65; and, CDR3, approximately residues 105 to 116 (germline) or residues 105 to 117 (rearranged). In one embodiment, it is contemplated that the CDRs are located at approximately residues 26-31 (L1), 49-51 (L2) and 88-98 (L3) in the light chain variable domain and approximately residues 26-33 (H1), 51-58 (H2) and 97-110 (H3) in the heavy chain variable domain of an antibody heavy or light chain of approximately similar length to those disclosed herein. However, one of skill in the art understands that the actual location of the CDR residues may vary from the projected residues described above when the sequence of the particular antibody is identified. CDRs as disclosed herein are defined following Kabat methodology (Kabat and Wu, 1991) and are numbered using Amgen Reference numbering. Amgen Reference numbering is a structurally based numbering system built upon the Honegger and Plückthun numbering system for antibody variable regions described in Honegger and Plückthun, (J Mol Biol. 309(3):657-70, 2001). In various embodiments, an engineered IgG1 antibody is contemplated. In various embodiment, the antibody is an IgG1z or IgG1z-SEFL2 antibody as described herein.

Framework region (or FR) residues are those variable domain residues other than the hypervariable region residues.

As described below, antibodies, including monoclonal, human, humanized, and other antibodies described herein, contemplated herein are typically generated recombinantly or through other methods of manipulating the genetic code in vitro or in vivo, and are therefore not necessarily reflective of a particular antibody that is found in nature.

In various embodiments, the antigen binding protein specifically binds to a cell surface protein so that IL-10 or an IL-10 mutein is directed to a particular cell type. Such cell types of interest include myeloid cells, CD8+ T cells, CD4+ T cells, and B cells. The antigen binding protein can specifically bind to TREM-1 for direction of IL-10 moieties to myeloid cells; to PD1, CD8, LAG3, NKG2D, NKG7 or other CD8+ T cell surface proteins for CD8+ T cells; bind to CD4 or other CD4+ T cell surface proteins such as CD30, OX40, 41BB, ICOS for CD4+ T cells; and bind to CD20, CD19 or other B cell surface proteins such as BAFFR for B cells.

In various embodiments, the antigen binding protein specifically binds to a cell surface protein that plays a role in immune checkpoint modulation. Such immune checkpoint modulators include PD-1, CTLA4, CD28, CD80, CD86, and the like.

In various embodiments the antigen binding protein specifically binds to cell surface proteins more greatly expressed on specific tissues or organs (e.g., intestine or lung) than on other organs or tissues. Such tissue- or organ-specific cell surface proteins include MAdCAM1 in the gut, surfactant or RAGE in the lung. Fusion proteins of IL-10 muteins with such antigen binding proteins are useful in treating such inflammatory diseases as IBD, asthma, and chronic obstructive pulmonary disorder (COPD).

In various embodiments, the antigen binding protein specifically binds to cell surface proteins more greatly expressed on tumor/cancerous cells than in cancer-free cells. Such tumor/cancer-specific antigens include BCMA, CD19, CD20, CD22, CD70, CD123, CEA, CDH3, CLDN6, CLL1, CS1, DCAF4L2, FLT3, GABRP, MageB2, MART-1, MSLN, MUC1 (e.g., MUC1-C), MUC12, MUC13, MUC16, mutFGFR3, PRSS21, PSMA, RNF43, STEAP1, STEAP2, TM4SF5, PD-1, CTLA4, EGFR, VEGF, OX40, or FcRL5. Anti-TREM-1 Antigen Binding Proteins Previous studies to characterize TREM-1 signaling utilized agonistic antibodies of TREM-1 to mimic ligand activation of the receptor (Tessarz et al., Immunol Lett 116(2):111-6, 2008; Vandestienne et al., J Clin Invest 131 (2): e142468, 2021). Decoy peptides have also been attempted to modulate TREM-1 activity (se e.g., International Patent Publication No. WO2014037565A.

The present disclosure encompasses use of amino acid molecules encoding target specific antibodies. The anti-TREM-1 antigen binding proteins, described herein, differentially modulate interaction of human TREM-1 and its ligands.

In some embodiments, an antigen binding protein is provided that comprises a polypeptide having an amino acid sequence at least about 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or more identical to the heavy chain variable region set out in SEQ ID NOs: 42, 62, 82, 102. 122, 142, 162, 182, 202, 222, 242, 262, 282, 302 and 2186 and/or an amino acid sequence an amino acid sequence at least about 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or more identical to the light chain variable region set out in SEQ ID NOs: 41, 61, 81, 101, 121, 141, 161, 181, 201, 221, 241, 261, 281, 301 and 2185, the antibody further comprising at least one, two, three, four, five or all of HCDR1, HCDR2, HCDR3, LCDR1, LCDR2 or LCDR3. In some embodiments, the amino acid sequence with percentage identity to the light chain variable region may comprise one, two or three of the light chain CDRs. In other embodiments, the amino acid sequence with percentage identity to the heavy chain variable region may comprise one, two, or three of the heavy chain CDRs.

In another embodiment, an antigen binding protein is provided that comprises a polypeptide having an amino acid sequence at least about 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or more identical to all three HCDRs in the heavy chain variable region of an antibody sequence set out above or the CDRs: heavy chain CDR1 sequence set out in SEQ ID NO: 36, 56, 76, 96, 116, 136, 156, 176, 196, 216, 236, 256, 276, 296 and 2196; heavy chain CDR2 sequence is set out in SEQ ID NO: 37, 57, 77, 97, 117, 137, 157, 177, 197, 217, 237, 257, 277, 297 and 2197; and heavy chain CDR3 sequence set out in SEQ ID NO: 38, 58, 78, 98, 118, 138, 158, 178, 198, 218, 238, 258, 278, 298 and 2198.

In a related embodiment, an antigen binding protein is provided that comprises a polypeptide having an amino acid sequence at least about 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or more identical to the all three LCDRs in the light chain variable region of an antibody sequence set out above or the CDRs: light chain CDR1 sequence is set out in SEQ ID NO: 30, 50, 70, 90, 110, 130, 150, 170, 190, 210, 230, 250, 270, 290 and 2190; light chain CDR2 sequence is set out in SEQ ID NOS: 31, 51, 71, 91, 111, 131, 151, 171, 191, 211, 231, 251, 271, 291 and 2191; light chain CDR3 sequence is set out in SEQ ID NOS: 32, 52, 72, 92, 112, 132, 152, 172, 192, 212, 232, 252, 272, 292 and 2192.

It is contemplated that the antibodies of the disclosure may have one, or two or more amino acid substitutions in the CDR regions of the antibody, e.g., non-conservative or conservative substitutions. Also contemplated are consensus sequences of the TREM-1 antibody heavy and light chain CDRs and/or variable region sequences disclosed herein. For example, TREM-1 antibodies or antigen binding proteins/fusion proteins can comprise the following sequences. In various embodiments, the TREM-1 antibody comprises an antigen binding domain comprising a sequence having a light chain variable region comprising a LCDR1 amino acid sequence selected from the group consisting of: $X_1ASQSX_2X_3X_4NLA$ (SEQ ID NO: 2199), wherein $X_1$ is R or Q, wherein $X_2$ is V or I, wherein $X_3$ is N or S, and wherein $X_4$ is S, H, I, V or A; $QASX_1DIX_2X_3X_4LN$ (SEQ ID NO: 2204), wherein $X_1$ is R or Q, wherein $X_2$ is R, S, N or F, wherein $X_3$ is K or N, and wherein $X_4$ is H, Y or D; RASQSVNSNLA (SEQ ID NO: 2212); QASQDIRKHLN (SEQ ID NO: 2213); RASQDISSNLN (SEQ ID NO: 2214); QASQDIHLN (SEQ ID NO: 2215); RASQGIRKWLA (SEQ ID NO: 2216) or RASQSVNSNLA (SEQ ID NO: 2217) and SGDKLGERVS (SEQ ID NO: 2218).

In various embodiments, the TREM-1 antibody comprises an antigen binding domain comprising a sequence having a light chain variable region comprising a LCDR2 amino acid sequence selected from the group consisting of $GAX_1X_2RAT$ (SEQ ID NO: 2200), wherein $X_1$ is S or Y, and wherein $X_2$ is T or I; an amino acid sequence $X_1X_2X_3X_4LET$ (SEQ ID NO: 2206), wherein $X_1$ is D, G or H, wherein $X_2$ is A, V or T, wherein $X_3$ is S, A or Y, and wherein $X_4$ is T or N; GASTRAT (SEQ ID NO: 2219); DASNLET (SEQ ID NO: 2220); and AASRLQS (SEQ ID NO: 2221).

In various embodiments, the TREM-1 antibody comprises an antigen binding domain comprising a sequence having a light chain variable region comprising a LCDR3 amino acid sequence selected from the group consisting of $QX_1X_2X_3X_4X_5X_6PX_7T$ (SEQ ID NO: 2201); wherein $X_1$ is Q, H or E, wherein $X_2$ is F or Y, wherein $X_3$ is K, Y or I, wherein $X_4$ is N, T, L, I, or M; wherein $X_5$ is W, F, H or Y, wherein $X_6$ is absent or P; wherein $X_7$ is W, N, Y, H or L; $QX_1YX_3X_4X_5PX_6T$ (SEQ ID NO: 2207), wherein $X_1$ is Q or H, wherein $X_2$ is D, A or G, wherein $X_3$ is N or K; wherein $X_4$ is L or I, and wherein $X_5$ is I or L; QQFKNWPPT (SEQ ID NO: 2222); QHYDNLPIT (SEQ ID NO: 2223); LQAHGFPWT (SEQ ID NO: 2224); QQYDNLPLT (SEQ ID NO: 2225) and QFWPPWT (SEQ ID NO: 2226).

In various embodiments, the TREM-1 antibody comprises an antigen binding domain comprising a sequence having a heavy chain variable region comprising a HCDR1 amino acid sequence selected from the group consisting of $X_1X_2X_3MX_4$ (SEQ ID NO: 2202), wherein $X_1$ is A, R, T or S, wherein $X_2$ is Y or N, wherein $X_3$ is A or W, and wherein $X_4$ is S or N; a sequence $X_1YDIN$ (SEQ ID NO: 2208), wherein $X_1$ is R or S; $GYYX_1H$ (SEQ ID NO: 2723), wherein $X_1$ is M or I; AYAMS (SEQ ID NO: 2227); RYDIN (SEQ ID NO: 2228); and SYWMS (SEQ ID NO: 2229).

In various embodiments, the TREM-1 antibody comprises an antigen binding domain comprising a sequence having a heavy chain variable region comprising a HCDR2 amino acid sequence selected from the group consisting of $X_1X_2X_3X_4X_5X_6\ X_7\ X_8\ X_9YYX_{10}X_{11}X_{12}VKG$ (SEQ ID NO: 2205), wherein $X_1$ is T, E, or S, wherein $X_2$ is absent or is M, V, or I, wherein $X_3$ is S, R or K, wherein $X_4$ is G or Q, wherein $X_5$ is S, D or H, wherein $X_6$ is G, S L, or A, wherein $X_7$ is S, G, or R, wherein $X_8$ is T, S, P or E, wherein $X_9$ is T or I, wherein $X_{10}$ is A or V, wherein $X_{11}$ is D or E, and wherein $X_{12}$ is S or A; $X_1X_2NPX_3X_4GX_5X_6GX_7X_9$ $X_9X_{10}FX_{11}X_{12}$ (SEQ ID NO: 2209), wherein $X_1$ is W or R, wherein $X_2$ is M or L, wherein $X_3$ is N, Q, or K, wherein $X_4$ is S, A, or R, wherein $X_5$ is N, or Q, wherein $X_6$ is S, A, or T, wherein $X_7$ is S, Q, or Y, wherein $X_8$ is V or T, wherein $X_9$ is Q or K, wherein $X_{10}$ is K or N, wherein $X_{11}$ is R or Q, and wherein $X_{12}$ is G or D; TSGSGSTTYYADSVKG (SEQ ID NO: 2230); WMNPNSGNSSVQKFRG (SEQ ID NO: 2231); NIKQDGSEEYYVDSVKG (SEQ ID NO: 2232); and TSGSGTYYADSVKG (SEQ ID NO: 2669).

In various embodiments, the TREM-1 antibody comprises an antigen binding domain comprising a sequence having a heavy chain variable region comprising a HCDR3 amino acid sequence selected from the group consisting of $X_1X_2X_3X_4X_5X_6\ X_7\ F\ X_8YYX_9$ (SEQ ID NO: 2203), wherein $X_1$ is V, E, A or G, wherein $X_2$ is A, F, Y or G, wherein $X_3$ is G, S, Y or W, wherein $X_4$ is S or R, wherein $X_5$ is absent or is N, wherein $X_6$ is F, S, Y, or absent, wherein $X_7$ is L or F or absent, wherein $X_8$ is D or E, and wherein $X_9$ is Y, H or S; $X_1X_2X_3X_4\ X_5X_6\ X_7\ X_8\ X_9X_{10}X_{11}X_{12}FX_{13}X_{14}$ (SEQ ID NO: 2210); wherein $X_1$ is G, L or R, wherein $X_2$ is G, I, or R, wherein $X_3$ is Y, R, I, G, or A, wherein $X_4$ is T, S, Y, or V, wherein $X_5$ is S or Y, wherein $X_6$ is S, A, I, or R, wherein $X_7$ is W, A, or S, wherein $X_8$ is absent or is S, wherein $X_9$ is absent or is F, W, or Y, wherein $X_{10}$ is R, S, H, K, or E, wherein $X_{11}$ is W, H, Y, or F, wherein $X_{12}$ is Y, V, A, or S, wherein $X_{13}$ is D or Q, and wherein $X_{14}$ is L, Y, I, or H; VAGSNFLFDY (SEQ ID NO: 2670); GGYTSS-WRWYFDL (SEQ ID NO: 2671); GGYTSSWSRWYFDL (SEQ ID NO: 2672); and DYGDSFDY (SEQ ID NO: 2673).

In various embodiments, the anti-TREM-1 antigen-binding protein or anti-TREM1 antigen-binding portion of an antigen binding protein comprises a set of CDR sequences selected from:

i) SEQ ID NO: 30 (LCDR1), SEQ ID NO: 31 (LCDR2), SEQ ID NO: 32 (LCDR3), SEQ ID NO: 36 (HCDR1), SEQ ID NO: 37 (HCDR2) and SEQ ID NO: 38 (HCDR3);

ii) SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3);

iii) SEQ ID NO: 70 (LCDR1), SEQ ID NO: 71 (LCDR2), SEQ ID NO: 72 (LCDR3), SEQ ID NO: 76 (HCDR1), SEQ ID NO: 77 (HCDR2) and SEQ ID NO: 78 (HCDR3);

iv) SEQ ID NO: 90 (LCDR1), SEQ ID NO: 91 (LCDR2), SEQ ID NO: 92 (LCDR3), SEQ ID NO: 96 (HCDR1), SEQ ID NO: 97 (HCDR2) and SEQ ID NO: 98 (HCDR3);

v) SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) and SEQ ID NO: 118 (HCDR3);

vi) SEQ ID NO: 130 (LCDR1), SEQ ID NO: 131 (LCDR2), SEQ ID NO: 132 (LCDR3), SEQ ID NO: 136 (HCDR1), SEQ ID NO: 137 (HCDR2) and SEQ ID NO: 138 (HCDR3);

vii) SEQ ID NO: 150 (LCDR1), SEQ ID NO: 151 (LCDR2), SEQ ID NO: 152 (LCDR3), SEQ ID NO: 156 (HCDR1), SEQ ID NO: 157 (HCDR2) and SEQ ID NO: 158 (HCDR3);

viii) SEQ ID NO: 170 (LCDR1), SEQ ID NO: 171 (LCDR2), SEQ ID NO: 172 (LCDR3), SEQ ID NO: 176 (HCDR1), SEQ ID NO: 177 (HCDR2) and SEQ ID NO: 178 (HCDR3);

ix) SEQ ID NO: 190 (LCDR1), SEQ ID NO: 191 (LCDR2), SEQ ID NO: 192 (LCDR3), SEQ ID NO: 196 (HCDR1), SEQ ID NO: 197 (HCDR2) and SEQ ID NO: 198 (HCDR3);

x) SEQ ID NO: 210 (LCDR1), SEQ ID NO: 211 (LCDR2), SEQ ID NO: 212 (LCDR3), SEQ ID NO: 216 (HCDR1), SEQ ID NO: 217 (HCDR2) and SEQ ID NO: 218 (HCDR3);

xi) SEQ ID NO: 230 (LCDR1), SEQ ID NO: 231 (LCDR2), SEQ ID NO: 232 (LCDR3), SEQ ID NO: 236 (HCDR1), SEQ ID NO: 237 (HCDR2) and SEQ ID NO: 238 (HCDR3);

xii) SEQ ID NO: 250 (LCDR1), SEQ ID NO: 251 (LCDR2), SEQ ID NO: 252 (LCDR3), SEQ ID NO: 256 (HCDR1), SEQ ID NO: 257 (HCDR2) and SEQ ID NO: 258 (HCDR3);

xiii) SEQ ID NO: 270 (LCDR1), SEQ ID NO: 271 (LCDR2), SEQ ID NO: 272 (LCDR3), SEQ ID NO: 276 (HCDR1), SEQ ID NO: 277 (HCDR2) and SEQ ID NO: 278 (HCDR3);

xiv) SEQ ID NO: 290 (LCDR1), SEQ ID NO: 291 (LCDR2), SEQ ID NO: 292 (LCDR3), SEQ ID NO: 296 (HCDR1), SEQ ID NO: 297 (HCDR2) and SEQ ID NO: 298 (HCDR3); and xv) SEQ ID NO: 2190 (LCDR1), SEQ ID NO: 2191 (LCDR2), SEQ ID NO: 2192 (LCDR3), SEQ ID NO: 2196 (HCDR1), SEQ ID NO: 2197 (HCDR2) and SEQ ID NO: 2198 (HCDR3).

In various embodiments, the anti-TREM-1 antigen-binding protein or anti-TREM1 antigen-binding portion of an antigen binding protein comprises a set of CDR sequences selected from:

i) SEQ ID NO: 30 (LCDR1), SEQ ID NO: 31 (LCDR2), SEQ ID NO: 32 (LCDR3), SEQ ID NO: 36 (HCDR1), SEQ ID NO: 37 (HCDR2) and SEQ ID NO: 38 (HCDR3);

ii) SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3);

iii) SEQ ID NO: 70 (LCDR1), SEQ ID NO: 71 (LCDR2), SEQ ID NO: 72 (LCDR3), SEQ ID NO: 76 (HCDR1), SEQ ID NO: 77 (HCDR2) and SEQ ID NO: 78 (HCDR3);

iv) SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) and SEQ ID NO: 118 (HCDR3);

v) SEQ ID NO: 150 (LCDR1), SEQ ID NO: 151 (LCDR2), SEQ ID NO: 152 (LCDR3), SEQ ID NO: 156 (HCDR1), SEQ ID NO: 157 (HCDR2) and SEQ ID NO: 158 (HCDR3);

vi) SEQ ID NO: 170 (LCDR1), SEQ ID NO: 171 (LCDR2), SEQ ID NO: 172 (LCDR3), SEQ ID NO: 176 (HCDR1), SEQ ID NO: 177 (HCDR2) and SEQ ID NO: 178 (HCDR3); and vii) SEQ ID NO: 290 (LCDR1), SEQ ID NO: 291 (LCDR2), SEQ ID NO: 292 (LCDR3), SEQ ID NO: 296 (HCDR1), SEQ ID NO: 297 (HCDR2) and SEQ ID NO: 298 (HCDR3).

In various embodiments, the anti-TREM-1 antigen-binding protein or anti-TREM1 antigen-binding portion of an antigen binding protein comprises a set of CDR sequences selected from: a light chain SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3; and a heavy chain SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) and SEQ ID NO: 118 (HCDR3).

In a related embodiment, the residues of the framework are altered. The heavy chain framework regions which can be altered lie within regions designated H-FR1, H-FR2, H-FR3 and H-FR4, which surround the heavy chain CDR residues, and the residues of the light chain framework regions which can be altered lie within the regions designated L-FR1, L-FR2, L-FR3 and L-FR4, which surround the light chain CDR residues. An amino acid within the framework region may be replaced, for example, with any suitable amino acid identified in a human framework or human consensus framework. It is further contemplated that the framework regions may be altered, but the antigen binding protein or antibodies described herein retain the CDRs, LCDR1-3 and/or HCDR-3, of the parent antibodies.

Antibody fragments comprise a portion of an intact full length antibody, preferably an antigen binding or variable region of the intact antibody. Examples of antibody fragments include Fab, Fab', F(ab')2, Fcab, and Fv fragments; diabodies; linear antibodies; single-chain antibody molecules (e.g., scFv); multispecific antibody fragments such as bispecfic, trispecific, etc. antibodies (e.g., diabodies, triabodies, tetrabodies); minibody; chelating recombinant antibody; tribodies or bibodies; intrabodies; nanobodies; binding-domain immunoglobulin fusion proteins; camelized antibodies; VHH containing antibodies; and other polypeptides formed from antibody fragments. See for example Holliger & Hudson, 2005 Nat. Biotech. 23:1126-36; Eyer & Hruska, Veterinarni Medicina 57:439-513, 2012.

The antigen binding compounds of the present disclosure preferably retain binding affinity of $10^{-8}$, $10^{-9}$, $10^{-10}$, $10^{-11}$, $10^{-12}$, $10^{-13}$, $10^{14}$, $10^{-15}$ M or less for TREM-1, as measured by surface plasmon resonance or KinexA. The antigen binding compounds of the present disclosure have binding affinity for TREM-1 from $10^{-9}$ to $10^{-12}$, or $10^{-10}$ to $10^{-13}$, or $10^{-10}$ to $10^{-15}$ M. The SPR assay is carried out using standard methods, for example, at 25° C. (e.g., room temperature).

In various embodiments, the antibody is an IgG1 antibody. In certain embodiments, the antibody is an IgG1z antibody.

Examples of full length antibodies that bind TREM-1 are provided herein having the heavy chain amino acid sequences set out in SEQ ID NOS: 26, 46, 66, 86, 106, 126, 146, 166, 186, 206, 226, 246, 266, 286 and 2186; and the corresponding light chain amino acid sequences set out in SEQ ID NOS: 25, 45, 65, 85, 105, 125, 145, 165, 185, 205, 225, 245, 265, 285 and 2185.

Antigen Binding Proteins Comprising IL-10

Further contemplated herein are antigen binding proteins between IL-10 muteins and antibodies or other binding proteins that target subpopulations of immune cells. Exemplary antibodies or antigen binding proteins include antibodies or binding proteins that target TREM-1 or target checkpoint inhibitors, such as PD-1, PD-L1, PD-L2, CTLA4, antibodies or binding proteins that target TNFα, or antibodies or binding proteins that target IL-12/IL-23.

Antibodies to checkpoint inhibitors, include, but are not limited to, PD-1 antibodies such as pembrolizumab (KEYTRUDA®, Merck Sharp & Dohme Corp.), nivolumab (Opdivo®, Bristol-Myers Squibb), and antibodies to PD-1 described in U.S. Pat. Nos. 8,735,553; 8,617,546; 8,008, 449; 8,741,295; 8,552,154; 8,354,509; 8,779,105; 7,563, 869; 8,287,856; 8,927,697; 8,088,905; 7,595,048; 8,168, 179; 6,808,710; 7,943,743; 8,246,955; and 8,217,149 and International Patent Publication WO 2019/140196; anti-CTLA-4 antibodies such as ipilimumab (YERVOY®) and tremelimumab, and anti-PD-L1 antibodies such as durvalumab.

Exemplary sequences of IL-10 mutein/anti-TREM-1 antibody antigen binding proteins are set out in SEQ ID NOS: 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1Q83, and 1085 and SEQ ID NO: 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, and 1086. Additional TREM-1 heavy chain -IL10 antigen binding proteins are set out in SEQ ID NOs: 2137, 2139, 2141, 2143, 2145, 2147, 2149, 2151, 2153, 2155, 2157, 2159, 2161, 2163, 2165, 2167, 2169, 2171, 2173, 2175, 2177, 2179, 2181, 2359, 2361, 2363, 2365, 2367, 2369, 2371, 2373, 2375, 2377, 2379, 2381, 2383, 2385, 2387, 2389, 2391, 2393, 2395, 2397, 2399, 2401, 2403, 2405, 2407, 2409, 2411, 2143, 2415, 2417, 2419, 2421, 2423, 2425, 2427, 2429, 2431, 2433, 2435, 2437, 2439, 2441, 2443, 2445, 2447, 2449, 2451, 2453, 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2498, 2499, 2501, 2503, 2505, 2507, 2509, 2511, 2513, 2515, 2517, 2519, 2521, 2523, 2525, 2527, 2529, 2531, 2533, 2535, 2537, 2539 and 2726-2776.

Examples of monovalent anti-TREM-1 antibody antigen binding proteins are set out in amino acid SEQ ID NOS: 1087 to 1422 and Table 13B.

Nucleic acids encoding antigen binding proteins comprising IL-10 muteins and anti-TREM-1 antibodies set out in SEQ ID NOS: 303 to 862, and TREM-1 variant antibody heavy chain variable regions set out in SEQ ID NOS: 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, and 2136 and TREM-1 variant antibody light chain variable regions set out in SEQ ID NO: 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346, 2348, 2350, 2352, 2354, 2356, and 2358.

Provided herein is an antigen binding protein comprising an antigen-binding moiety and one or two IL-10 moieties wherein: a. the antigen-binding moiety is an antibody or antibody fragment, b. each IL-10 moiety is independently monovalent or bivalent, c. each IL-10 moiety is independently selected from one or more human IL-10 muteins having sequences that are 90% identical to SEQ ID NO: 2, and d. at least one IL-10 moiety is covalently bound to the antigen-binding moiety. In various embodiments, at least one IL-10 moiety is fused to a C-terminus of the antigen-binding moiety.

In various embodiments of the antigen binding protein: a. the antigen-binding moiety is an antibody and b. an IL-10 moiety is fused to each heavy chain of the antibody.

In various embodiments of the antigen binding protein, each IL-10 moiety is a monomer. In various embodiments the antigen binding protein comprises two different mutein monomers. In various embodiments, the antigen binding protein comprises two of the same mutein monomers.

In various embodiments, for the antigen binding protein: each IL-10 moiety comprises an amino acid sequence that is at least 90% identical to the amino acid sequence set forth in SEQ ID NO: 2 and each IL-10 moiety independently comprises at least one mutation selected from a mutation in helical loop AB, helical loop CD, helical loop DE, helix A, helix B, helix C, helix D, helix E and/or helix F.

In various embodiments, at least one IL-10 moiety comprises at least one mutation in helix A. In various embodiments, at least one IL-10 moiety comprises at least one mutation in helix F. In various embodiments, at least one IL-10 moiety comprises at least one mutation in helical loop AB.

In various embodiments, the IL-10 mutein reduces the suppression of TNF-α production in myeloid cells, reduces levels of CD8+ T cell stimulation, and/or reduces the level of B cell stimulation compared to wt IL-10.

In various embodiments, the IL-10 mutein antigen binding protein suppresses TNF-α production in myeloid cells. In various embodiments, the IL-10 mutein antigen binding protein suppresses TNF-α production in myeloid cells, while reducing CD8+ T cell and B cell activation.

In various embodiments, the treatment inhibits TNF-α production in monocytes, without CD8+ T cell stimulation and/or B cell stimulation in the subject.

In various embodiments, each IL-10 mutein independently comprises a mutation in one or more of residues N10, H14, F15, P20, M22, L23, R24, R27, D28, K34, T35, Q38, M39, K40, D41, Q42, L43, D44, N45, L46, L47, L48, K49, F56, K57, Y59, L60, Q3, E67, Q70, M77, Q79, N82, Q83, D84, P85, D86, I87, A89, H90, S93, T100, L103, H109, R110, L112, E115, N116, A127, K130, I136, Y137, K138, S141, E142, D144, I145, E151, M154, M156, K157, N160 of SEQ ID NO: 2 and/or an addition of 4-8 amino acids between helix D and helix E.

In various embodiments, each IL-10 mutein is at least 95% identical to the amino acid sequence set forth in SEQ ID NO: 2. In various embodiments, each IL-10 mutein independently comprises one or more mutations selected from the group consisting of R27L, K34D, D41G, L46K, Q38E, Q38R, Q38D, K138L, K138D, or I87A of SEQ ID NO: 2, optionally comprising an addition of amino acids between helix D and helix E. In various embodiments, each IL-10 mutein independently comprises one or more mutations selected from the group consisting of N10Q, N10I, N10K, R27L, K34D, D41G, L46K, Q38E, Q38R, Q38D, K138L, K138D, I87A, H14Q, F15Y, M22V, K49T, K49S, F56Y, K57N, Y59T, L60Q, Q63E, Q63L, E67C, Q70E, 070K, M77R, M77V, Q79R, Q79C, D84R, A89P, H90E, H900, S93E, S93Q, T100R, 103E, H109D, R110P, R110Q, L112V, E115K, N116D, N116Q, A127M, K130Q, I136C, Y137C, M154V, M156C, K157N, or N160D, optionally comprising an addition of amino acids between helix D and helix E. In various embodiments, the amino acids between helix D and helix E are GGGSGG (SEQ ID NO: 2676). Optionally, the IL-10 mutein has a combination of mutations as set out in Table 1, Table 16, Table 17 or Table 21.

In various embodiments, each IL-10 mutein is at least 95% identical to the amino acid sequence set forth in SEQ ID NO: 2. In various embodiments, each IL-10 mutein independently comprises one or more mutations selected from the group consisting of N10, R27L, K34D, D41G, L46K, Q38E, Q38R, Q38D, K138L, K138D, or I87A of SEQ ID NO: 2, optionally comprising an addition of six amino acids between helix D and helix E. In various embodiments, each IL-10 mutein independently comprises one or more mutations selected from the group consisting of N10Q, N10I, N10K, R27L, K34D, D41G, L46K, Q38E, Q38R, Q38D, K138L, K138D, I87A, H14Q, F15Y, M22V, K49T, K49S, F56Y, K57N, Y59T, L60Q, Q63E, Q63L, E67C, Q70E, Q70K, M77R, M77V, Q79R, Q79C, D84R, A89P, H90E, H90Q, S93E, S93Q, T100R, L103E, H109D, R110P, R1100, L112V, E115K, N116D, N116Q, A127M, K130Q, I136C, Y137C, M154V, M156C, K157N, OR N160D of SEQ ID NO: 2, optionally comprising an addition of six amino acids between helix D and helix E. In various embodiments, the amino acids between helix D and helix E are GGGSGG (SEQ ID NO: 2676). In various embodiments, the amino acid sequence of the IL-10 mutein is set out in SEQ ID NOS: 3-10 and SEQ ID NOS: 2138, 2140, 2142, 2144, 2146, 2148, 2150, 2152, 2154, 2156, 2158, 2160, 2162, 2164, 2166, 2168, 2170 2172, 2174, 2176, 2178, 2180, 2182, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2500, 2502, 2504, 2506, 2508, 2510, 2512, 2514, 2516, 2518, 2520, 2522, 2524, 2526, 2528, 2530, 2532, 2534, 2536, 2540 and 2777-2791.

In various embodiments, the antigen binding protein comprises at least one linker fused to at least one C-terminus of the antigen-binding moiety and an IL-10 mutein moiety is covalently bound to the C-terminus of each linker. In various embodiments, the linker is between 4 and 18 amino acids long. In various embodiments, the linker is six amino acids long. In various embodiments, the linker is a 3-mer, 4-mer, 5-mer, 6-mer, 7-mer or 8-mer peptide. In various embodiments, the linker comprises GS residues. Additional linkers contemplated for use are described below.

In various embodiments, the antigen binding protein further comprises a human heavy chain constant region attached to said heavy chain variable region of the antibody portion of the antigen binding protein. In various embodiments, the antigen binding protein further comprises a human light chain constant region attached to said light chain variable region of the antibody portion of the antigen binding protein.

In various embodiments of the antigen binding protein, the antigen-binding moiety is selected from the group consisting of a human antibody, a humanized antibody, a chimeric antibody, a monoclonal antibody, a recombinant antibody, a Fab, a F(ab')2, a Fab2, a monovalent IgG, an scFv, an scFv-Fc, an IgG1 antibody, an IgG2 antibody, an IgG3 antibody, and an IgG4 antibody. In various embodiments, the antigen-binding moiety is an IgG. In various embodiments, the antigen-binding moiety is an IgG2 antibody. In various embodiments, the antigen-binding moiety is an IgG1 antibody. In various embodiments, the antibody is an IgG1z antibody. In various embodiments, the antigen-binding moiety is a monovalent IgG. In various embodiments, the heavy chain constant region of the antigen-binding moiety is selected from heavy chain constant regions of an IgG, IgM, IgA, IgD, IgE, fragments thereof, combinations thereof, and modifications thereof in which one to ten heavy chain framework amino acids are replaced with corresponding amino acid(s) from another human antibody constant region.

In various embodiments of the antigen binding protein, the antigen-binding moiety binds to human PD-1 having the amino acid sequence set forth in SEQ ID NO: 22. In various embodiments, the antigen-binding moiety binds to human TREM-1 having the amino acid sequence set forth in SEQ ID NO: 20. In various embodiments, the antigen-binding moiety binds to the human TREM-1 with a binding affinity of at least $10^{-8}$ M.

In various embodiments, the antigen binding moiety binds its antigen with a binding affinity of $10^{-8}$ M to $10^{-15}$ M or $10^{-8}$ M to $10^{-12}$ M, or $10^{-8}$ M, $10^{-9}$ M, $10^{-10}$ M, $10^{-11}$ M, $10^{-12}$ M, $10^{-13}$ M, 10-14 M, or 10-15 M.

In various embodiments of the antigen binding protein, the anti-TREM-1 antigen binding moiety comprises:

a. a light chain variable domain comprising:
   i. a light chain CDR1 comprising an amino acid sequence selected from SEQ ID NOS: 30, 50, 70, 90, 110, 130, 150, 170, 190, 210, 230, 250, 270, 290 and 2190;
   ii. a light chain CDR2 comprising an amino acid sequence selected from SEQ ID NOS: 31, 51, 71, 91, 111, 131, 151, 171, 191, 211, 231, 251, 271, 291 and 2191;
   iii. a light chain CDR3 comprising an amino acid sequence selected from SEQ ID NOS: 32, 52, 72, 92, 112, 132, 152, 172, 192, 212, 232, 252, 272, 292 and 2192; and
b. comprises a heavy chain variable domain comprising:
   i. a heavy chain CDR1 comprising an amino acid sequence selected from SEQ ID NOS: 36, 56, 76, 96, 116, 136, 156, 176, 196, 216, 236, 256, 276, 296 and 2196;

ii. a heavy chain CDR2 comprising an amino acid sequence selected from SEQ ID NOS: 37, 57, 77, 97, 117, 137, 157, 177, 197, 217, 237, 257, 277, 297 and 2197; and iii. a heavy chain CDR3 comprising an amino acid sequence selected from SEQ ID NOS: 38, 58, 78, 98, 118, 138, 158, 178, 198, 218, 238, 258, 278, 298 and 2198.

In various embodiments of the antigen binding protein,
a. the light chain CDR1 sequence is set out in SEQ ID NO: 30, 50, 70, 110, 150, 170, or 290;
b. the light chain CDR2 sequence is set out in SEQ ID NO: 31, 51, 71, 111, 151, 171, or 291;
c. the light chain CDR3 sequence is set out in SEQ ID NO: 32, 52, 72, 112, 152, 172, or 292
d. the heavy chain CDR1 sequence is set out in SEQ ID NO: 36, 56, 76, 116, 156, 176, or 296;
e. the heavy chain CDR2 sequence is set out in SEQ ID NO: 37, 57, 77, 117, 157, 177, or 297; and
f. the heavy chain CDR3 sequence is set out in SEQ ID NO: 38, 58, 78, 118, 158, 178, or 298.

In various embodiments of the antigen binding protein,
a. the light chain CDR1 sequence is set out in SEQ ID NO: 50 or 110;
b. the light chain CDR2 sequence is set out in SEQ ID NO: 51 or 111;
c. the light chain CDR3 sequence is set out in SEQ ID NO: 52 or 112;
d. the heavy chain CDR1 sequence is set out in SEQ ID NO: 56 or 116;
e. the heavy chain CDR2 sequence is set out in SEQ ID NO: 57 or 117; and
f. the heavy chain CDR3 sequence is set out in SEQ ID NOS: 58 or 118.

In various embodiments of the antigen binding protein, the antigen binding protein comprises a set of CDR sequences selected from:
i) SEQ ID NO: 30 (LCDR1), SEQ ID NO: 31 (LCDR2), SEQ ID NO: 32 (LCDR3), SEQ ID NO: 36 (HCDR1), SEQ ID NO: 37 (HCDR2) and SEQ ID NO: 38 (HCDR3);
ii) SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3);
iii) SEQ ID NO: 70 (LCDR1), SEQ ID NO: 71 (LCDR2), SEQ ID NO: 72 (LCDR3), SEQ ID NO: 76 (HCDR1), SEQ ID NO: 77 (HCDR2) and SEQ ID NO: 78 (HCDR3);
iv) SEQ ID NO: 90 (LCDR1), SEQ ID NO: 91 (LCDR2), SEQ ID NO: 92 (LCDR3), SEQ ID NO: 96 (HCDR1), SEQ ID NO: 97 (HCDR2) and SEQ ID NO: 98 (HCDR3);
v) SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) and SEQ ID NO: 118 (HCDR3);
vi) SEQ ID NO: 130 (LCDR1), SEQ ID NO: 131 (LCDR2), SEQ ID NO: 132 (LCDR3), SEQ ID NO: 136 (HCDR1), SEQ ID NO: 137 (HCDR2) and SEQ ID NO: 138 (HCDR3);
vii) SEQ ID NO: 150 (LCDR1), SEQ ID NO: 151 (LCDR2), SEQ ID NO: 152 (LCDR3), SEQ ID NO: 156 (HCDR1), SEQ ID NO: 157 (HCDR2) and SEQ ID NO: 158 (HCDR3);

viii) SEQ ID NO: 170 (LCDR1), SEQ ID NO: 171 (LCDR2), SEQ ID NO: 172 (LCDR3), SEQ ID NO: 176 (HCDR1), SEQ ID NO: 177 (HCDR2) and SEQ ID NO: 178 (HCDR3);
ix) SEQ ID NO: 190 (LCDR1), SEQ ID NO: 191 (LCDR2), SEQ ID NO: 192 (LCDR3), SEQ ID NO: 196 (HCDR1), SEQ ID NO: 197 (HCDR2) and SEQ ID NO: 198 (HCDR3);
x) SEQ ID NO: 210 (LCDR1), SEQ ID NO: 211 (LCDR2), SEQ ID NO: 212 (LCDR3), SEQ ID NO: 216 (HCDR1), SEQ ID NO: 217 (HCDR2) and SEQ ID NO: 218 (HCDR3);
xi) SEQ ID NO: 230 (LCDR1), SEQ ID NO: 231 (LCDR2), SEQ ID NO: 232 (LCDR3), SEQ ID NO: 236 (HCDR1), SEQ ID NO: 237 (HCDR2) and SEQ ID NO: 238 (HCDR3);
xii) SEQ ID NO: 250 (LCDR1), SEQ ID NO: 251 (LCDR2), SEQ ID NO: 252 (LCDR3), SEQ ID NO: 256 (HCDR1), SEQ ID NO: 257 (HCDR2) and SEQ ID NO: 258 (HCDR3);
xiii) SEQ ID NO: 270 (LCDR1), SEQ ID NO: 271 (LCDR2), SEQ ID NO: 272 (LCDR3), SEQ ID NO: 276 (HCDR1), SEQ ID NO: 277 (HCDR2) and SEQ ID NO: 278 (HCDR3);
xiv) SEQ ID NO: 290 (LCDR1), SEQ ID NO: 291 (LCDR2), SEQ ID NO: 292 (LCDR3), SEQ ID NO: 296 (HCDR1), SEQ ID NO: 297 (HCDR2) and SEQ ID NO: 298 (HCDR3); and
xv) SEQ ID NO: 2190 (LCDR1), SEQ ID NO: 2191 (LCDR2), SEQ ID NO: 2192 (LCDR3), SEQ ID NO: 2196 (HCDR1), SEQ ID NO: 2197 (HCDR2) and SEQ ID NO: 2198 (HCDR3).

In various embodiments of the antigen binding protein, the anti-TREM-1 antigen-binding moiety comprises:
a. a light chain variable domain comprising an amino acid sequence selected from the group consisting of:
i. a sequence at least 80% identical to an amino acid sequence selected from SEQ ID NOS: 41, 61, 81, 101, 121, 141, 161, 181, 201, 221, 241, 261, 281, 301 and 2185;
ii. a sequence encoded by a polynucleotide sequence that is at least 80% identical to a nucleic acid sequence selected from SEQ ID NOS: 39, 59, 79, 99, 119, 139, 159, 179, 199, 219, 239, 259, 279, 299 and 2183;
iii. a sequence encoded by a polynucleotide that hybridizes under moderately stringent conditions to the complement of a polynucleotide consisting of a nucleic acid sequence selected from SEQ ID NOS: 39, 59, 79, 99, 119, 139, 159, 179, 199, 219, 239, 259, 279, 299 and 2183; and
b. a heavy chain variable domain comprising an amino acid sequence selected from the group consisting of:
i. a sequence that is at least 80% identical to an amino acid sequence selected from SEQ ID NOS: 42, 62, 82, 102. 122, 142, 162, 182, 202, 222, 242, 262, 282, 302 and 2186;
ii. a sequence encoded by a polynucleotide sequence that is at least 80% identical to an amino acid sequence selected from SEQ ID NOS: 40, 60, 80, 100, 120, 140, 160, 180, 200, 220, 240, 260, 280, 300 and 2184; and
iii. a sequence encoded by a polynucleotide that hybridizes under moderately stringent conditions to the complement of a polynucleotide consisting of a nucleic sequence selected from SEQ ID NOS: 40, 60, 80, 100, 120, 140, 160, 180, 200, 220, 240, 260, 280, 300 and 2186.

In various embodiments of the antigen binding protein, the anti-TREM-1 antigen-binding moiety comprises:

a. a light chain variable domain comprising an amino acid sequence selected from the group consisting of:

i. a sequence at least 80% identical to an amino acid sequence selected from SEQ ID NOS: 41, 61, 81, 121, 161, 181, and 301;

ii. a sequence encoded by a polynucleotide sequence that is at least 80% identical to a nucleic acid sequence selected from SEQ ID NOS: 39, 59, 79, 119, 159, 179, and 299;

iii. a sequence encoded by a polynucleotide that hybridizes under moderately stringent conditions to the complement of a polynucleotide consisting of a nucleic acid sequence selected from SEQ ID NOS: 39, 59, 79, 119, 159, 179, and 299; and b. a heavy chain variable domain comprising an amino acid sequence selected from the group consisting of:

i. a sequence that is at least 80% identical to an amino acid sequence selected from SEQ ID NOS: 42, 62, 82, 122, 162, 182, and 302;

ii. a sequence encoded by a polynucleotide sequence that is at least 80% identical to an amino acid sequence selected from SEQ ID NOS: 40, 60, 80, 120, 160, 180, and 300;

iii. a sequence encoded by a polynucleotide that hybridizes under moderately stringent conditions to the complement of a polynucleotide consisting of a nucleic sequence selected from SEQ ID NOS: 40, 60, 80, 120, 160, 180 and 300.

In various embodiments of the antigen binding protein, the anti-TREM-1 antigen-binding moiety comprises:

a. a light chain variable domain comprising an amino acid sequence selected from the group consisting of:

i. a sequence at least 80% identical to an amino acid sequence selected from SEQ ID NOS: 61 and 121;

ii. a sequence encoded by a polynucleotide sequence that is at least 80% identical to a nucleic acid sequence selected from SEQ ID NOS: 59 and 119;

iii. a sequence encoded by a polynucleotide that hybridizes under moderately stringent conditions to the complement of a polynucleotide consisting of a nucleic acid sequence selected from SEQ ID NOS: 59 and 119; and b. a heavy chain variable domain comprising an amino acid sequence selected from the group consisting of:

i. a sequence that is at least 80% identical to an amino acid sequence selected from SEQ ID NOS: 62 and 122;

ii. a sequence encoded by a polynucleotide sequence that is at least 80% identical to an amino acid sequence selected from SEQ ID NOS: 60 and 120;

iii. a sequence encoded by a polynucleotide that hybridizes under moderately stringent conditions to the complement of a polynucleotide consisting of a nucleic sequence selected from SEQ ID NOS: 60 and 120.

In various embodiments, the anti-TREM-1 antigen-binding protein or anti-TREM1 antigen-binding portion of a antigen binding protein comprises:

i) a light chain variable domain set out in SEQ ID NO: 41 and a heavy chain variable domain set out in SEQ ID NO: 42;

ii) a light chain variable domain set out in SEQ ID NO: 61 and a heavy chain variable domain set out in SEQ ID NO: 62;

iii) a light chain variable domain set out in SEQ ID NO: 81 and a heavy chain variable domain set out in SEQ ID NO: 82;

iv) a light chain variable domain set out in SEQ ID NO: 101 and a heavy chain variable domain set out in SEQ ID NO: 102;

v) a light chain variable domain set out in SEQ ID NO: 121 and a heavy chain variable domain set out in SEQ ID NO: 122;

vi) a light chain variable domain set out in SEQ ID NO: 141 and a heavy chain variable domain set out in SEQ ID NO: 142;

vii) a light chain variable domain set out in SEQ ID NO: 161 and a heavy chain variable domain set out in SEQ ID NO: 162;

viii) a light chain variable domain set out in SEQ ID NO: 181 and a heavy chain variable domain set out in SEQ ID NO: 182;

ix) a light chain variable domain set out in SEQ ID NO: 201 and a heavy chain variable domain set out in SEQ ID NO: 202;

x) a light chain variable domain set out in SEQ ID NO: 221 and a heavy chain variable domain set out in SEQ ID NO: 222;

xi) a light chain variable domain set out in SEQ ID NO: 241 and a heavy chain variable domain set out in SEQ ID NO: 242;

xii) a light chain variable domain set out in SEQ ID NO: 261 and a heavy chain variable domain set out in SEQ ID NO: 262;

xiii) a light chain variable domain set out in SEQ ID NO: 281 and a heavy chain variable domain set out in SEQ ID NO: 282;

xiv) a light chain variable domain set out in SEQ ID NO: 301 and a heavy chain variable domain set out in SEQ ID NO: 302; or xv) a light chain variable domain set out in SEQ ID NO: 2185 and a heavy chain variable domain set out in SEQ ID NO: 2186.

In various embodiments of the antigen binding protein, the amino acid sequences can be 80%, 85%, 90%, 91%, 92%, 93%, 94%, 95%, 96%, 97%, 98% or 99% identical to SEQ ID NOs: 41, 61, 81, 101, 121, 141, 161, 181, 201, 221, 241, 261, 281, 301 and 2185 and SEQ ID NO: 42, 62, 82, 102. 122, 142, 162, 182, 202, 222, 242, 262, 282, 302 and 2186.

In various embodiments of the antigen binding protein, the antigen binding moiety comprises an amino acid sequence at least 90% identical to a heavy chain variable region amino acid sequence selected from SEQ ID NOS: 42, 62, 82, 102. 122, 142, 162, 182, 202, 222, 242, 262, 282, 302 and 2186.

In various embodiments of the antigen binding protein, the antigen-binding moiety comprises an amino acid sequence at least 90% identical to a light chain variable region amino acid sequence selected from SEQ ID NOs: 41, 61, 81, 101, 121, 141, 161, 181, 201, 221, 241, 261, 281, 301 and 2185.

In various embodiments of the antigen binding protein, the antigen binding moiety comprises a heavy chain amino acid sequence at least 90% identical to a sequence selected from SEQ ID NOS: 42, 62, 82, 122, 142, 162, 182, and 302and a light chain amino acid sequence at least 90% identical to a sequence selected from SEQ ID NOS: 41, 61, 81, 121, 141, 161, 181, and 301.

In various embodiments of the antigen binding protein, the antigen binding moiety comprises a heavy chain amino acid sequence at least 90% identical to a sequence selected from SEQ ID NOS: 62 and 122, and a light chain amino acid sequence at least 90% identical to a sequence selected from SEQ ID NOS: 61 and 121.

In various embodiments, the antigen binding protein comprises a heavy chain amino acid sequence selected from SEQ ID NOS: 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1Q83, and 1085 and a light chain amino acid sequence selected from SEQ ID NOS: 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, and 1086.

In various embodiments, provided herein are variants of the TREM-1 antibody heavy chain and/or light chain variable regions. TREM-1 antibody heavy chain variable region variant sequences are set out in SEQ ID NOS: 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2011, 2013, 2015, 2017, 2019, 2021, 2026, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, 2135 and Table 10 and Table 11, and TREM-1 antibody light chain variable region variant sequences are set out in SEQ ID NO: 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, 2605, 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, 2357, Table 10 and Table 11. It is contemplated that a TREM-1-IL-10 antigen binding protein comprises a TREM-1 antibody variant heavy chain and/or light chain sequence as disclosed herein.

In various embodiments of the antigen binding proteins, one or more heavy chain framework amino acids of the anti-antigen-binding protein are replaced with corresponding amino acid(s) from another human antibody amino acid sequence. In various embodiments, one or more light chain framework amino acids of the antigen-binding protein are replaced with corresponding amino acid(s) from another human antibody amino acid sequence.

In various embodiments, the anti-TREM-1 antigen binding protein further comprises a human light chain constant region attached to said light chain variable region.

In various embodiments of the antigen binding protein: the antigen binding protein comprises two light chains and two heavy chains: each heavy chain comprises an IL-10 moiety attached at the C-terminus of the heavy chain; each heavy-chain-IL-10 moiety antigen binding protein comprises an amino acid sequence at least 90% identical to a sequence selected from SEQ ID NOS: 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1Q83, and 1085; and each light chain comprises an amino acid sequence at least 90% identical to a sequence selected from SEQ ID NOS: 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, and 1086.

In various embodiments, the antigen binding protein may be monovalent. In various embodiments the heavy-chain-IL-10 moiety antigen binding protein comprises an amino acid sequence at least 90% identical to a sequence selected from SEQ ID NOS: 1087, 1090, 1093, 1096, 1105, 1108, 1111, 1114, 1117, 1123, 1126, 1129, 1132, 1138, 1141, 1147, 1150, 1153, 1156, 1159, 1162, 1165, 1168, 1171, 1174, 1177, 1180, 1183, 1186, 1189, 1192, 1195, 1198, 1201, 1204, 1207, 1210, 1213, 1216, 1219, 1222, 1225, 1228, 1231, 1237, 1240, 1243, 1246, 1252, 1255, 1258, 1261, 1264, 1267, 1270, 1273, 1276, 1279, 1285, 1288, 1294, 1297, 1300, 1303, 1309, 1312, 1315, 1318, 1321, 1324, 1333, 1336, 1342, 1345, 1348, 1351, 1354, 1357, 1360, 1363, 1366, 1369, 1372, 1375, 1378, 1381, 1384, 1387, 1390, 1393, 1396, 1399, 1402, 1408, 1411, 1414, 1417, and 1420. In various embodiments, the light-chain comprises an amino acid sequence at least 90% identical to a sequence selected from SEQ ID NOS: 1088, 1091, 1094, 1097, 1106, 1109, 1112, 1115, 1118, 1124, 1127, 1130, 1133, 1139, 1142, 1148, 1151, 1154, 1157, 1160, 1163, 1166, 1169, 1172, 1175, 1178, 1181, 1184, 1187, 1190, 1193, 1196, 1199, 1202, 1205, 1208, 1211, 1214, 1217, 1220, 1223, 1226, 1229, 1232, 1238, 1241, 1244, 1247, 1253, 1256, 1259, 1262, 1265, 1268, 1271, 1274, 1277, 1280, 1286, 1289, 1295, 1298, 1301, 1304, 1310, 1313, 1316, 1319, 1322, 1325, 1334, 1337, 1343, 1346, 1349, 1352, 1355, 1358, 1361, 1364, 1367, 1370, 1373, 1376, 1379, 1382, 1385, 1388, 1391, 1394, 1397, 1400, 1403, 1409, 1412, 1415, 1418 and 1421. In various embodiments, the monovalent antigen binding protein further comprises an Fc region, e.g., as set out in SEQ ID NO: 1089, 1092, 1095, 1098, 1107, 1110, 1113, 1116, 1119, 1125, 1128, 1131, 1134, 1140, 1143, 1149, 1152, 1155, 1158, 1161, 1164, 1167, 1170, 1173, 1176, 1179, 1182, 1185, 1188, 1191, 1194, 1197, 1200, 1203, 1206, 1209, 1212, 1215, 1218, 1221, 1224, 1227, 1230, 1233, 1239, 1242, 1245, 1248, 1254, 1257, 1260, 1263, 1266, 1269, 1272, 1275, 1278, 1281, 1287, 1290, 1296, 1299, 1302, 1305, 1311, 1314, 1317, 1320, 1323, 1326, 1335, 1338, 1344, 1347, 1350, 1353, 1356, 1359, 1362, 1365, 1368, 1371, 1374, 1377, 1380, 1383, 1386, 1389, 1392, 1395, 1398, 1401, 1404, 1410, 1413, 1416, 1419 and 1422.

In various embodiments of the antigen binding protein: the antigen binding protein comprises two light chains and two heavy chains: each heavy chain comprises an IL-10 moiety attached at the C-terminus of the heavy chain; each heavy-chain-IL-10 moiety antigen binding protein comprises an amino acid sequence at least 90% identical to a sequence selected from SEQ ID NOS: 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, 2007, 2011, 2013, 2015, 2017, 2019, 2021, 2026, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, 2135 and sequences set out in Table 10, Table 11, Table 16, and Table 17; and each light chain comprises an amino acid sequence at least 90% identical to a sequence selected from SEQ ID NO: 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, 2605, 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, 2357, and sequences set out in Table 10 and Table 11. In various embodiments of the antigen binding protein: the antigen binding protein comprises two light chains and two heavy chains: each heavy chain comprises an IL-10 moiety attached at the C-terminus of the heavy chain; each heavy-chain-IL-10 moiety antigen binding protein comprises an amino acid sequence at least 90% identical to a sequence selected from SEQ ID NOS: 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, and 2007, and each light chain comprises an amino acid sequence at least 90% identical to a sequence selected from SEQ ID NO: 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, 2605.

In various embodiments of the antigen binding protein: the antigen binding protein comprises two light chains and two heavy chains: each heavy chain comprises an IL-10 moiety attached at the C-terminus of the heavy chain; each heavy-chain-IL-10 moiety antigen binding protein comprises an amino acid sequence at least 90% identical to a sequence selected from SEQ ID NOS: 2011, 2013, 2015, 2017, 2019, 2021, 2026, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, and 2135, and each light chain comprises an amino acid sequence at least 90% identical to a sequence selected from SEQ ID NO: 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, and 2357.

In various embodiments, the antigen binding protein comprises a heavy chain amino acid sequence at least 90% identical to a sequence set out in any one of SEQ ID NOS: 2726-2776. In various embodiments, the antigen binding protein comprises a heavy chain amino acid sequence set out in any one of SEQ ID NOS: 2726-2776. In various embodiments, the antigen binding protein has a heavy chain-IL-10 moiety amino acid sequence selected from the group consisting of SEQ ID NOS: 2727-2732.

In various embodiments, antigen binding protein comprises the heavy chain amino acid sequence of SEQ ID NO: 2727 or 2728, and the light chain amino acid sequence set out in SEQ ID NO: 976 or SEQ ID NO: 2554 or other 63F8 or 63F8.001 light chain. In various embodiments, the antigen binding protein comprises the heavy chain amino acid sequence of SEQ ID NO: 2729, 2730, 2731 or 2732, and the light chain amino acid sequence set out in SEQ ID NO: 992 or SEQ ID NO: 2555 or other 64D7 or 64D7.001 light chain.

In various embodiments of the antigen binding protein, the anti-TREM-1 antigen-binding moiety inhibits binding of TREM-1 to a TREM-1 ligand.

In various embodiments, at least one IL-10 moiety is fused to an N-terminus of the antigen-binding moiety. In various embodiments, at least one IL-10 moiety is fused to an N and C terminus of the antigen binding moiety. In various embodiments, the IL-10 moiety is fused at an internal site in the antigen binding moiety, for example, the IL-10 moiety is fused between the CH1 domain and the hinge regions of a heavy chain or at sites described in U.S. Pat. No. 8,008,453, incorporated herein by reference. In various embodiments, at least one IL-10 moiety is fused to a heavy and/or light chain of the antigen-binding moiety. In various embodiments, the heavy chain and/or light chain is a modified or engineered heavy chain or light chain.

Nucleic Acid Molecules

The disclosure also provides isolated nucleic acids encoding the IL-10 muteins, antigen binding proteins and antigen binding proteins comprising an antigen binding moiety and an IL-10 moiety as described herein, which includes, for instance, the IL-10 mutein sequence, the antigen binding protein light chain, light chain variable region, light chain constant region, antigen binding protein heavy chain, heavy chain variable region, heavy chain constant region, linkers, fusion proteins, and any and all components and combinations thereof. Nucleic acids of the invention include nucleic acids having at least 80%, more preferably at least about 90%, more preferably at least about 95%, and most preferably at least about 98% homology to nucleic acids of the invention. The terms "percent similarity", "percent identity" and "percent homology" when referring to a particular sequence are used as set forth in the University of Wisconsin GCG® software program. Nucleic acids of the disclosure also include complementary nucleic acids. In some instances, the sequences will be fully complementary (no mismatches) when aligned. In other instances, there may be up to about a 20% mismatch in the sequences. In some embodiments of the invention are provided nucleic acids encoding both a heavy chain and a light chain of an antibody of the disclosure.

Nucleic acids of the disclosure can be cloned into a vector, such as a plasmid, cosmid, bacmid, phage, artificial chromosome (BAC, YAC) or virus, into which another genetic sequence or element (either DNA or RNA) may be inserted so as to bring about the replication of the attached sequence or element. In some embodiments, the expression vector contains a constitutively active promoter segment (such as but not limited to CMV, SV40, Elongation Factor or LTR sequences) or an inducible promoter sequence such as the steroid inducible pIND vector (Invitrogen), where the expression of the nucleic acid can be regulated. Expression vectors of the invention may further comprise regulatory sequences, for example, an internal ribosomal entry site. The expression vector can be introduced into a cell by transfection, for example.

Also provided is an expression vector comprising the following operably linked elements; a transcription promoter; a first nucleic acid molecule encoding an IL-10 mutein, the heavy chain of an antigen binding protein, antibody or antigen-binding fragment of the disclosure, or fusion protein; a second nucleic acid molecule encoding the light chain of a antigen binding protein, antibody or antigen-binding fragment of the disclosure; and a transcription terminator. In another embodiment, the present disclosure provides an expression vector comprising the following operably linked elements; a first transcription promoter; a first nucleic acid molecule encoding the IL-10 mutein, heavy chain of an antigen binding protein, antibody or antigen-binding fragment of the disclosure, or a fusion protein thereof; a first transcription terminator; a second transcription promoter optionally, a second nucleic acid molecule encoding the light chain of an antigen binding protein, antibody or antigen-binding fragment of the disclosure; and a second transcription terminator.

A secretory signal peptide sequence can also, optionally, be encoded by the expression vector, operably linked to the coding sequence of interest, so that the expressed polypeptide can be secreted by the recombinant host cell, for more facile isolation of the polypeptide of interest from the cell, if desired. For instance, in some embodiments, signal peptide sequences may be appended/fused to the amino terminus of any of the IL-10 mutein, antigen binding protein, antibody or antigen binding fragment thereof or fusion protein polypeptide sequences described herein Recombinant host cells comprising such vectors and expressing the IL-10 mutein, antigen binding protein heavy and light chains, or antigen binding proteins comprising an antigen binding moiety and an IL-10 moiety are also provided. The recombinant host cell may be a prokaryotic cell, for example an *E. coli* cell, or a eukaryotic cell, for example a mammalian cell or a yeast cell. Yeast cells include *Saccharomyces cerevisiae, Schizosaccharomyces pombe*, and *Pichia pastoris* cells. Mammalian cells include VERO, HeLa, Chinese hamster Ovary (CHO), W138, baby hamster kidney (BHK), COS-7, MDCK, human embryonic kidney line 293, normal dog kidney cell lines, normal cat kidney cell lines, monkey kidney cells, African green monkey kidney cells, COS cells, and non-tumorigenic mouse myoblast G8 cells, fibroblast cell lines, myeloma cell lines, mouse NIH/3T3 cells, LMTK31 cells, mouse sertoli cells, human cervical carcinoma cells, buffalo rat liver cells, human lung cells, human liver cells, mouse mammary tumor cells, TRI cells, MRC 5 cells, and FS4 cells. Recombinant protein-producing cells of the disclosure also include any insect expression cell line known, such as for example, *Spodoptera frugiperda* cells. In one embodiment, the cells are mammalian cells. In a certain embodiment, the mammalian cells are CHO cells.

Protein purification methods are known in the art and utilized herein for recovery of recombinant proteins from cell culture media. For example, methods of protein and antibody purification are known in the art and can be employed with production of the antibodies of the present disclosure. In some embodiments, methods for protein and antibody purification include filtration, affinity column chromatography, cation exchange chromatography, anion exchange chromatography, and concentration. The filtration step may comprise ultrafiltration, and optionally ultrafiltration and diafiltration. Filtration is preferably performed at least about 5-50 times, more preferably 10 to 30 times, and most preferably 14 to 27 times. Affinity column chromatography, may be performed using, for example, PROSEP® Affinity Chromatography (Millipore, Billerica, Mass.). In various embodiments, the affinity chromatography step comprises PROSEP®-vA column chromatography. Eluate may be washed in a solvent detergent. Cation exchange chromatography may include, for example, SP-Sepharose Cation Exchange Chromatography. Anion exchange chromatography may include, for example but not limited to, Q-Sepharose Fast Flow Anion Exchange. The anion exchange step is preferably non-binding, thereby allowing removal of contaminants including DNA and BSA. The antibody product is preferably nanofiltered, for example, using a Pall DV 20 Nanofilter. The antibody product may be concentrated, for example, using ultrafiltration and diafiltration. The method may further comprise a step of size exclusion chromatography to remove aggregates.

In various embodiments, the nucleotide sequences set out in SEQ ID NOs: 11-18 are useful for expressing the IL-10 muteins herein or fragments thereof or variants thereof.

In some embodiments, different nucleic acid molecules encode a heavy chain variable region and a light chain variable region of a target specific antibody. In other embodiments, the same nucleic acid molecule encodes a heavy chain and a light chain variable regions of a target specific antibody. In one embodiment, the nucleic acid encodes a target specific antibody of the present disclosure, as well as any of the polypeptides encoded by the nucleic acids described herein.

In some embodiments, the nucleic acid molecule encodes a VH amino acid sequence that is at least 70%, 75%, 80%, 85%, 90%, 95%, 96%, 97%, 98% or 99% identical to a VH amino acid sequence set out in SEQ ID NOs: 42, 62, 82, 102, 122, 142, 162, 182, 202, 222, 242, 262, 282, 302 and 2186. Nucleic acid molecules of the disclosure further include nucleic acids that hybridize under highly stringent conditions, such as those described herein, to a nucleic acid sequence encoding the heavy chain variable region amino acid sequence of SEQ ID NOs: 42, 62, 82, 102, 122, 142, 162, 182, 202, 222, 242, 262, 282, 302, and 2186 or that has the heavy chain variable region nucleic acid sequence of any one of SEQ ID NOs: 40, 60, 80, 100, 120, 140, 160, 180, 200, 220, 240, 260, 280, 300 and 2184.

In some embodiments, the nucleic acid molecule encodes a VL amino acid sequence that is at least 70%, 75%, 80%, 85%, 90%, 95%, 96%, 97%, 98% or 99% identical to a VL amino acid sequence set out in SEQ ID NOs: 41, 61, 81, 101, 121, 141, 161, 181, 201, 221, 241, 261, 281, 301 and 2185. Nucleic acid molecules of the disclosure further include nucleic acids that hybridize under highly stringent conditions, such as those described herein, to a nucleic acid sequence encoding the light chain variable region amino acid sequence of SEQ ID NOs: 41, 61, 81, 101, 121, 141, 161, 181, 201, 221, 241, 261, 281, 301 and 2185, or that has the light chain variable region nucleic acid sequence of any one of SEQ ID NOs: 39, 59, 79, 99, 119, 139, 159, 179, 199, 219, 239, 259, 279, 299 and 2183.

In one aspect, a nucleic acid molecule of the present disclosure comprises a nucleotide sequence that encodes the VL amino acid sequence of anti-TREM-1 antigen binding proteins set out in herein or a portion thereof. In a related aspect, the VL amino acid sequence is a consensus sequence. In some embodiments, the nucleic acid encodes the amino acid sequence of the light chain CDRs of said antibody. In some embodiments, said portion is a contiguous portion comprising LCDR1-CDR3. In a related aspect, the LCDR1-3 amino acid sequences are consensus sequences. In one embodiment, said portion comprises at least one, two or three of a light chain CDR1, CDR2, or CDR3 region, optionally with a different human or human consensus framework, and optionally with 1, or up to 2, or up to 3 mutations in the collective 3 CDRs.

In one aspect, a nucleic acid molecule of the present disclosure comprises a nucleotide sequence that encodes the VH amino acid sequence of anti-TREM-1 antigen binding proteins set out herein, or a portion thereof. In a related aspect, the VH amino acid sequence is a consensus sequence. In some embodiments, the nucleic acid encodes the amino acid sequence of the heavy chain CDRs of said antibody. In some embodiments, said portion is a contiguous portion comprising HCDR1-CDR3. In a related aspect, the HCDR1-3 amino acid sequences are consensus sequences. In one embodiment, said portion comprises at least one, two or three of a heavy chain CDR1, CDR2, or CDR3 region, optionally with a different human or human consensus framework, and optionally with 1, or up to 2, or up to 3 mutations in the collective 3 CDRs.

Nucleic acid sequences of certain antigen binding protein heavy and light chains are set out in SEQ ID NOS: 303 to 526 (bivalent) and SEQ ID NOS: 527 to 862 (monovalent). Nucleic acid sequences of TREM-1 variant antibody heavy chain variable regions are set out in SEQ ID NOS: 2012, 2014, 2016, 2018, 2020, 2022, 2024, 2026, 2028, 2030, 2032, 2034, 2036, 2038, 2040, 2042, 2044, 2046, 2048, 2050, 2052, 2054, 2056, 2058, 2060, 2062, 2064, 2066, 2068, 2070, 2072, 2074, 2076, 2078, 2080, 2082, 2084, 2086, 2088, 2090, 2092, 2094, 2096, 2098, 2100, 2102, 2104, 2106, 2108, 2110, 2112, 2114, 2116, 2118, 2120, 2122, 2124, 2126, 2128, 2130, 2132, 2134, and 2136 and TREM-1 variant antibody light chain variable regions nucleotide sequences are set out in SEQ ID NO: 2234, 2236, 2238, 2240, 2242, 2244, 2246, 2248, 2250, 2252, 2254, 2256, 2258, 2260, 2262, 2264, 2266, 2268, 2270, 2272, 2274, 2276, 2278, 2280, 2282, 2284, 2286, 2288, 2290, 2292, 2294, 2296, 2298, 2300, 2302, 2304, 2306, 2308, 2310, 2312, 2314, 2316, 2318, 2320, 2322, 2324, 2326, 2328, 2330, 2332, 2334, 2336, 2338, 2340, 2342, 2344, 2346, 2348, 2350, 2352, 2354, 2356, and 2358.

In exemplary embodiments, an antibody of the disclosure comprises a human kappa (κ) or a human lambda (λ) light chain or an amino acid sequence derived therefrom, or a human heavy chain or a sequence derived therefrom, or both heavy and light chains together in a single chain, dimeric, tetrameric or other form.

Linkers

Linkers or spacers include peptides or other moieties that are used to connect two molecules either by covalent or non-covalent bonds. Peptide moieties are contemplated herein within the IL-10 mutein polypeptides in order to provide stability and increased spacing of the IL-10 sequence for proper folding in monomer form. Peptide moieties are also contemplated herein for use in the antigen binding proteins of the disclosure providing a connection or spacer between the antigen binding moiety in the antigen binding protein and the IL-10 monomer/mutein to which it is fused.

The peptide linker joining the Fc region to the IL-10 mutein can be any of the peptide linkers described herein. In some embodiments, a linker can be 2-40, 3-40, 3-30, or 3-20 amino acids long. In various embodiments, a linker can be 3-25, 4-18, 4-20, 5-20, 6-18, or 10-20 amino acids long. In various embodiments, a linker can be about, 2, 3, 4, 5, 6, 7, 8, 9, 10, 11, 12, 13, 14, 15, 16, 17, 18, 19, 20, 21, 22, 23, 24, 25, 26, 27, 28, 29, or 30 amino acids long. In various embodiments, the linker is between 4 and 18 amino acids long. In certain embodiments, the peptide linker joining the Fc region to the IL-10 mutein is at least 4 amino acids, at least 5 amino acids, or at least 6 amino acids in length. In other embodiments, the peptide linker joining the Fc region to the carboxyl-terminal Fab fragment is at least 8 amino acids in length.

In some embodiments, a linker can be attached to the C terminus of the heavy chain of the antigen binding moiety in the antigen binding protein. In various embodiments, the linker is a 3-mer, 4-mer, 5-mer, 6-mer, 7-mer, 8-mer, or a repeating 3-, 4-, 5- or 6-mer. Exemplary linkers include, Gly-Gly-Gly-Gly (SEQ ID NO: 2677), Gly-Gly, Gly-Gly-Gly, Gly-Gly-Gly-Ser (SEQ ID NO: 2705), Gly-Gly-Gly-Pro (SEQ ID NO: 2706), Gly-Gly-Gly-Gln (SEQ ID NO: 2707), Gly-Gly-Gly-Gly-Gly (SEQ ID NO: 2708), Gly-Gly-Gly-Gly-Ser(SEQ ID NO: 2725), (Gly$_3$Ser)$_2$ (SEQ ID NO: 2709), (Gly$_4$Ser)$_2$ (SEQ ID NO: 2710), (Gly$_3$Ser)$_3$ (SEQ ID NO: 2711), (Gly$_4$Ser)$_3$(SEQ ID NO: 2712), (Gly$_3$Ser)$_4$(SEQ ID NO: 2713), (Gly$_4$Ser)$_4$(SEQ ID NO: 2714), (Gly$_3$Ser)$_5$ (SEQ ID NO: 2715), (Gly$_4$Ser)$_5$(SEQ ID NO: 2716), (Gly$_3$Ser)$_6$ (SEQ ID NO: 2717), (Gly$_4$Ser)$_6$(SEQ ID NO: 2718), Gly-Ser-Gly-Ser-Ala-Thr-Gly-Gly-Ser-Gly-Ser-Ser-Ala-Ser-Ser-Gly-Ser-Gly-Ser-Ala-Thr-His-Leu (SEQ ID NO: 2719), Gly-Ser-Gly-Ser-Ala-Thr-Gly-Gly-Ser-Gly-Ser-Val-Ala-Ser-Ser-Gly-Ser-Gly-Ser-Ala-Thr-His-Leu (SEQ

59

ID NO: 2720), Gly-Ser-Gly-Ser-Ala-Thr-Gly-Gly-Ser-Gly-Ser-Ser-Ala-Ser-Ser-Gly-Gly-Gly-Ser-Ala-Thr-His-Leu (SEQ ID NO: 2721), Gly-Ser-Gly-Ser-Ala-Thr-Gly-Gly-Ser-Gly-Ser-Gly-Ala-SeGGGr-Ser-Gly-Ser-Gly-Ser-Ala-Thr-Gly-Ser(SEQ ID NO: 2722), as well as linkers set out in the Examples.

Linker or spacer peptide moieties are also inserted in the IL-10 mutein for stability. For example a sequence of 4-8 amino acids can be added within the DE helix loop of wild type IL-10 or an IL-10 mutein. In various embodiments, the linker is 3, 4, 5, 6, 7, or 8 amino acids in length. In various embodiments, the linker is 6 amino acids. In various embodiments, the linker has the sequence GGGSGG (SEQ ID NO: 2676).

Derivatives

Suitable detectable molecules may be directly or indirectly attached to the IL-10 muteins, antigen binding proteins or fusion proteins of the present disclosure. Suitable detectable molecules include radionuclides, enzymes, substrates, cofactors, inhibitors, fluorescent markers, chemiluminescent markers, magnetic particles and the like. For indirect attachment of a detectable or cytotoxic molecule, the detectable or cytotoxic molecule can be conjugated with a member of a complementary/anti-complementary pair, where the other member is bound to the binding polypeptide or antibody portion. For these purposes, biotin/streptavidin is an exemplary complementary/anti-complementary pair.

The IL-10 muteins, antigen binding proteins and antigen binding proteins comprising an antigen binding moiety and an IL-10 moiety of the disclosure also include derivatives that are modified, e.g., by the covalent attachment of any type of molecule to the antibody such that covalent attachment does not prevent the antibody from binding to its epitope. Examples of suitable derivatives include but are not limited to derivatives that are fucosylated, glycosylated, acetylated, PEGylated, phosphorylated, or amidated. The IL-10 muteins, antigen binding proteins and antigen binding proteins comprising an antigen binding moiety and an IL-10 moiety and derivatives thereof of the disclosure may themselves by derivatized by known protecting/blocking groups, proteolytic cleavage, linkage to a cellular ligand or other proteins, and the like. In some embodiments of the disclosure, at least one heavy chain of the IL-10 mutein or antigen binding protein or antigen binding proteins comprising an antigen binding moiety and an IL-10 moiety is PEGylated. In some embodiments, the PEGylation is N-linked or is linked through the sidechain of an amino acid (e.g., lysine).

Glycosylation can contribute to the effector function of antibodies, particularly IgG1 antibodies. Thus, in some embodiments, the IL-10 muteins, antigen binding proteins or antigen binding proteins comprising an antigen binding moiety and an IL-10 moiety of the disclosure may comprise one or more amino acid substitutions that affect the level or type of glycosylation of the binding proteins. Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

In certain embodiments, glycosylation of the IL-10 muteins, antigen binding proteins and antigen binding proteins comprising an antigen binding moiety and an IL-10 moiety described herein is increased by adding one or more glycosylation sites, e.g., to the Fc region of the binding protein. Addition of glycosylation sites to the antigen binding protein can be conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the antigen binding protein amino acid sequence may be altered through changes at the DNA level, particularly by mutating the DNA encoding the target polypeptide at preselected bases such that codons are generated that will translate into the desired amino acids.

The disclosure also encompasses production of IL-10 muteins, antigen binding proteins and antigen binding proteins comprising an antigen binding moiety and an IL-10 moiety with altered carbohydrate structure resulting in altered effector activity, including antigen binding proteins with absent or reduced fucosylation that exhibit improved ADCC activity. Various methods are known in the art to reduce or eliminate fucosylation. For example, ADCC effector activity is mediated by binding of the antibody molecule to the FcγRIII receptor, which has been shown to be dependent on the carbohydrate structure of the N-linked glycosylation at the N297 residue of the CH2 domain. Non-fucosylated antibodies bind this receptor with increased affinity and trigger FcγRIII-mediated effector functions more efficiently than native, fucosylated antibodies. For example, recombinant production of non-fucosylated antibody in CHO cells in which the alpha-1,6-fucosyl transferase enzyme has been knocked out results in antibody with 100-fold increased ADCC activity (see Yamane-Ohnuki et al., *Biotechnol Bioeng.* 87(5):614-22, 2004). Similar effects can be accomplished through decreasing the activity of alpha-1,6-fucosyl transferase enzyme or other enzymes in the fucosylation pathway, e.g., through siRNA or antisense RNA treatment, engineering cell lines to knockout the enzyme(s), or culturing with selective glycosylation inhibitors (see Rothman et al., *Mol Immunol.* 26(12):1113-23, 1989). Some host cell strains, e.g. Lec13 or rat hybridoma YB2/0 cell line naturally produce antibodies with lower fucosylation levels (see Shields et al., *J Biol Chem.* 277(30): 26733-40, 2002 and Shinkawa et al., *J Biol Chem.* 278(5): 3466-73, 2003). An increase in the level of bisected carbohydrate, e.g. through recombinantly producing antibody in cells that overexpress GnTIII enzyme, has also been determined to increase ADCC activity (see Umana et al., *Nat Biotechnol.* 17(2):176-80, 1999).

In other embodiments, glycosylation of the IL-10 muteins, antigen binding proteins and antigen binding proteins comprising an antigen binding moiety and an IL-10 moiety described herein is decreased or eliminated by removing one or more glycosylation sites, e.g., from the Fc region of the binding protein. Amino acid substitutions that eliminate or alter N-linked glycosylation sites can reduce or eliminate N-linked glycosylation of the antigen binding protein. In certain embodiments, the bispecific antigen binding proteins described herein comprise a mutation at position N297 (EU numbering), such as N297Q, N297A, or N297G. In one particular embodiment, the bispecific antigen binding proteins of the invention comprise a Fc region from a human IgG1 antibody with a N297G mutation. To improve the stability of molecules comprising a N297 mutation, the Fc region of the molecules may be further engineered. For instance, in some embodiments, one or more amino acids in the Fc region are substituted with cysteine to promote disulfide bond formation in the dimeric state. Residues corresponding to V259, A287, R292, V302, L306, V323, or I332 (EU numbering) of an IgG1 Fc region may thus be substituted with cysteine. In one embodiment, specific pairs of residues are substituted with cysteine such that they preferentially form a disulfide bond with each other, thus limiting or preventing disulfide bond scrambling. In certain embodiments pairs include, but are not limited to, A287C and L306C, V259C and L306C, R292C and V302C, and V323C and I332C. In particular embodiments, the bispecific antigen binding proteins described herein comprise a Fc region from a human IgG1 antibody with mutations at R292C and V302C. In such embodiments, the Fc region may also comprise a N297G mutation.

Modifications of the IL-10 muteins, antigen binding proteins and antigen binding proteins comprising an antigen binding moiety and an IL-10 moiety of the disclosure to increase serum half-life also may desirable, for example, by incorporation of or addition of a salvage receptor binding epitope (e.g., by mutation of the appropriate region or by incorporating the epitope into a peptide tag that is then fused to the IL-10 muteins, antigen binding proteins and antigen binding proteins comprising an antigen binding moiety and an IL-10 moiety at either end or in the middle, e.g., by DNA or peptide synthesis; see, e.g., WO96/32478) or adding molecules such as PEG or other water soluble polymers, including polysaccharide polymers. The salvage receptor binding epitope preferably constitutes a region wherein any one or more amino acid residues from one or two loops of a Fc region are transferred to an analogous position in the antigen binding protein. In one embodiment, three or more residues from one or two loops of the Fc region are transferred. In one embodiment, the epitope is taken from the CH2 domain of the Fc region (e.g., an IgG Fc region) and transferred to the CH1, CH3, or VH region, or more than one such region, of the IL-10 muteins, antigen binding protein and antigen binding proteins comprising an antigen binding moiety and an IL-10 moiety. Alternatively, the epitope is taken from the CH2 domain of the Fc region and transferred to the CL region or VL region, or both, of the antigen binding protein. See International applications WO 97/34631 and WO 96/32478 for a description of Fc variants and their interaction with the salvage receptor.

The IL-10 muteins, antigen binding proteins and antigen binding proteins comprising an antigen binding moiety and an IL-10 moiety proteins of the disclosure include variants having single or multiple amino acid substitutions, deletions, additions, or replacements that retain their biological properties. A person of ordinary skill in the art can produce variants having single or multiple amino acid substitutions, deletions, additions or replacements. These variants may include, inter alia: (a) variants in which one or more amino acid residues are substituted with conservative or non-conservative amino acids, (b) variants in which one or more amino acids are added to or deleted from the polypeptide, (c) variants in which one or more amino acids include a substituent group, and (d) variants in which the polypeptide is fused with another peptide or polypeptide such as a fusion partner, a protein tag or other chemical moiety, that may confer useful properties to the polypeptide, such as, for example, an epitope for an antibody, a polyhistidine sequence, a biotin moiety and the like. Antibodies and bispecific antibodies of the invention may include variants in which amino acid residues from one species are substituted for the corresponding residue in another species, either at the conserved or non-conserved positions. In another embodiment, amino acid residues at non-conserved positions are substituted with conservative or non-conservative residues. The techniques for obtaining these variants, including genetic (suppressions, deletions, mutations, etc.), chemical, and enzymatic techniques, are known to the person having ordinary skill in the art.

Methods of Treatment

IL-10 potently inhibits inflammatory cytokines such as TNFα and IL-23 production from myeloid cells. Both TNFα and IL-23 are validated targets for treatment of inflammatory bowel disease. IL-10 also suppresses antigen presenting cells, including inhibition the induction of MHCII, CD86, and ICAM1. IL-10 also activates CD8+ T cells and B cells, though with a higher EC50, likely contributing to dose limiting toxicity of IL-10 in clinical study. rhIL-10 has a poor PK (t½=2.5-4 hr) and was unable to achieve cell type selectivity in clinic. High doses of rhIL-10 stimulates CD8+ T cells and B cells, while low doses exhibit insufficient tissue and myeloid cell coverage. Myeloid cell specific IL-10R1 KO mice develop similar colitis as IL-10 KO mice, suggesting IL-10 inhibition of myeloid cells is sufficient for the treatment of inflammatory bowel disease (IBD) (Zigmond et al., *Immunity* 40(5):720-33, 2014). Therefore, it is hypothesized herein that targeting IL-10 to myeloid cells through anti-TREM-1 mAb/IL10 mutein bispecific approach, or another targeting moiety, could reach sufficient anti-inflammatory activity on myeloid cells without stimulatory activities on CD8+ cells and B cells.

Human patients with IL-10, IL-10R1, or IL-10R2 homozygous loss of function mutations developed severe infantile IBD (Kotlarz et al., *Gastroenterology*, 143: 347-355, 2012; Glocker, *NEJM*, 61(21):2033-45, 2009). IL-10 is among genetic mutations associated with IBD (GWAS loci, rs3024505 RAF 0.16, or 1.46, p value $10^{-42}$, Jostins et al., *Nature* 491:119-124, 2012, deCODE rs3024505 IBD or 1.13, p value 0.024).

Triggering receptor expressed on myeloid cells 1 (TREM1, TREM-1) is an Ig family member expressed in neutrophil, monocyte and macrophage cells. TREM-1 inhibition might be desirable for IBD treatment since TREM-1 KO mice are viable and protected from DSS colitis and T cell transfer colitis (Weber, *PLoS Pathog*, 10(1):1003900, 2014). Treatment with a TREM-1-Fc fusion improved survival and reduced TNFα induction after LPS challenge in mice (Bouchon, Nature, 410:1103-7, 2001). TREM-1 has increased expression in the inflamed IBD tissues (Schenk et al., *J Clin Invest*. 117:3097-3106, 2007), increased expression in colonic macrophage in CX3CR1$^{cre}$IL10$^{fl/fl}$ mice (Zimond, *Immunity*, 40(5):720-33, 2014) and binds to DAP12 and induces Syk phosphorylation upon activation. It is hypothesized herein that TREM-1 serves as desirable targeting partner in an IL-10 antigen binding protein due to its high expression on myeloid cell surface.

PGLYRP1 (Peptidoglycan recognition protein 1) has recently been reported as a ligand for TREM-1 (Read, *J. Immunol*. 194: 1417-1421, 2015), and potential other ligands remain to be determined. An anti-TREM-1 antibody was reported to reduce secretion of inflammatory cytokines from lamina propria cells isolated from IBD patients stimulated with TREM-1 agonist PGLYRP-1/peptidoglycan (Brynjolfsson et al., *Inflamm Bowel Dis* 22(8):1803-11, 2016).

Readouts of efficacy of treatments in IBD include evaluating IL-10 IBD risk variant rs3024505 in regulation of IL-10 expression, evaluating heterogeneity of IL-10 levels in IBD patient serum and tissues, and assessing the potential correlation with disease severity, responses to therapies, for IBD risk variants.

Additional measures to determine efficacy include reduced IL-10 induced expression profile in myeloid cells and IBD tissues, analyzing heterogeneity of myeloid cell derived cytokines subjected to IL-10 suppression (e.g. TNFα, IL-23) in IBD samples, and determining the heterogeneity and number of monocyte and macrophage numbers in IBD inflamed tissues. It is contemplated that treatments herein with IL-10 mutein or antigen binding proteins will retain the suppression of myeloid cell activity and eliminate IL-10 activation of CD8+ T cells and B cells. It is contemplated that the treatment reduces the levels of inflammatory cytokines such as TNF-α and IL-23 in the subject.

It is contemplated that treatment with an anti-TREM-1 antigen binding protein or antigen binding proteins comprising an antigen binding moiety and an IL-10 moiety of the disclosure comprising an anti-TREM-1 binding protein reduces expression of TREM-1 in inflammatory cells.

Crohn's disease involves an abnormal inflammation of any portion of the alimentary tract from the mouth to the anus, although in most patients the abnormal inflammation is confined to the ileocolic, small-intestinal, and colonic-anorectal regions. Typically, the inflammation is discontinuous. Common symptoms include abdominal pain, anorexia, weight loss, fever, diarrhea, fullness and/or tenderness in the right lower quadrant of the abdomen, constipation, vomiting, and perianal discomfort and discharge. Other possible symptoms include peripheral arthritis, growth retardation, episcleritis, aphthous stomatitis, erythema nodosum, pyoderma gangrenosum, kidney stones, impaired urinary dilution and alkalinization, malabsorption, and gallstones, among others. See e.g. Strober et al., *Medical Immunology*, 10th Edition, Section III, Ch. 35 (2001); *Merck Manual of Diagnosis and Therapy*, 17th Edition, Section 3, Ch. 31 (1999). Macrophages isolated from patients with Crohn's disease produce increased amounts of IL-12, IFNγ, TNFα, and other inflammatory cytokines.

Ulcerative colitis is distinct from Crohn's disease in several respects. First, it is generally limited to the colon while Crohn's disease may occur throughout the alimentary tract. Second, ulcerative colitis mainly involves inflammation only of the superficial layers of the bowel, unlike Crohn's disease in which the inflammation can penetrate all way through the wall of the bowel or other location in the alimentary tract. Finally, ulcerative colitis typically involves a continuous area of inflammation, rather than the discontinuous sites of inflammation typical of Crohn's disease. Like Crohn's disease, ulcerative colitis is found primarily in urban areas. Also, genetic factors likely play a role in ulcerative colitis since there is a familial aggregation of cases. Autoantibodies are observed in ulcerative colitis patients more often than Crohn's disease patients. The autoantibodies are often directed to colonic epithelial cell components. Among the most common are antineutrophil cytoplasmic antibodies with specificities for catalase, α-enolase, and lactoferrin. In some cases such antibodies cross react with colonic microorganisms.

In clinical trials, Crohn's disease activity is often scored using the Crohn's Disease Activity Index (CDAI). The CDAI provides a disease activity score based on eight factors including (1) the number of liquid or soft stools per day, (2) a patient rating of the amount of abdominal pain per day, (3) a patient rating of general well-being, (4) a patient report of other symptoms including arthritis, iritis, uveitis, erythema nodosum, pyoderma gangrenosum, ephthous stomatitis, anal fissure, fitula, or abscess, other fistula, or fever, (5) patient report of taking lomotil or other opiates for diarrhea, (6) abdominal mass, (7) hematocrit, and (8) body weight. See, e.g., Best et al. (1976), *Gastroenterol.* 70: 439-444, the relevant portions of which are incorporated herein by reference.

Symptoms of ulcerative colitis are variable. They may include diarrhea, tenesmus, abdominal cramps, blood and mucus in the stool, fever, and rectal bleeding. Toxic megacolon, a potentially life-threatening condition in which the colon is dilated beyond about 6 centimeters and may lose its muscular tone and/or perforate, may also occur. Other symptoms that may accompany ulcerative colitis include peripheral arthritis, ankylosing spondylitis, sacroiliitis, anterior uveitis, erythema nodosum, pyoderma gangrenosum, episcleritis, autoimmune hepatitis, primary sclerosing cholangitis, cirrhosis, and retarded growth and development in children.

In some embodiments, a patient suffering from an inflammatory bowel disease (IBD), such as Crohn's disease or ulcerative colitis, can be treated with an IL-10 mutein, an anti-TREM-1 antigen binding protein or other antigen binding protein, or antigen binding protein comprising IL-10 as disclosed herein before, after, or concurrently with treatment with an existing therapy for IBD. Existing therapeutics for IBD include, for example, sulfasalazine, 5-aminosalicylic acid and its derivatives (such as olsalazine, balsalazide, and mesalamine), anti-TNF antibodies (including infliximab, adalimumab, golimumab, and certolizumab pegol), corticosteroids for oral or parenteral administration (including prednisone, methylprednisone, budesonide, or hydrocortisone), adrenocorticotropic hormone, antibiotics (including metronidazole, ciprofloxacin, or rifaximin), azathioprine, 6-mercaptopurine, methotrexate, cyclosporine, tacrolimus, and thalidomide.

In one embodiment, the disclosure provides a method of inhibiting one or more of proinflammatory cytokines, e.g., TNFα, in a mammal in need of such treatment comprising administering a therapeutically effective amount of an IL-10 mutein, an antigen binding protein or antibody of the disclosure, or a fusion protein described herein to a subject in need of such treatment. In a preferred embodiment, the subject is a mammal. In one embodiment, the subject is a human. The method may be used to treat a disorder characterized by elevated expression or activity of TNFα. The IL-10 mutein, antigen binding protein or antibody of the disclosure, or an antigen binding proteins comprising an antigen binding moiety and an IL-10 moiety described herein may be administered with another pharmaceutical agent, either in the same formulation or separately.

Rheumatoid arthritis (RA) is a chronic disease with systemic symptoms, as well as symptoms relating specifically to the joints. Symptoms commonly include synovitis, leading to painful and swollen joints, and various laboratory abnormalities such as higher-than-normal levels of rheumatoid factor, anti-citrulline modified protein (anti-CCP) antibodies, and C-reactive protein (CRP) and an elevated erythrocyte sedimentation rate (ESR). Less common symptoms include various extra-articular symptoms involving, e.g., tendons, ligaments, blood vessels, the heart, and the lungs. Disease activity can be often measured using a variety of indices. See, e.g., Anderson et al. (2012), *Arthritis Care & Res.* 64(5): 640-647, the portions of which discuss such indices are incorporated herein by reference. Elements included in such scoring indices include the number of tender joints, the number of swollen joints, functional assessments, and various laboratory findings such as CRP, ESR, etc.

In some embodiments, a patient suffering from RA can be treated with an IL-10 mutein, an anti-TREM-1 antigen binding or other antigen binding protein described herein, or an antigen binding proteins comprising an antigen binding moiety and an IL-10 moiety as disclosed herein before, after, or concurrently with treatment with a drug in current use for RA. Therapeutics currently in use for rheumatoid arthritis (RA) include non-steroidal anti-inflammatory drugs (NSAIDs) (such aspirin and cyclooxygenase-2 (COX-2) inhibitors), disease modifying anti-inflammatory drugs (DMARDs, such as methotrexate, leflunomide, and sulfasa-lazine), anti-materials (such as hydroxychloroquine), cyclo-phosphamide, D-penicillamine, azathioprine, gold salts, tumor necrosis factor inhibitors (such as etanercept, inflix-imab, adalimumab, golimumab, and certolizumab pegol), CD20 inhibitors such as rituximab, IL-1 antagonists such as anakinra, IL-6 inhibitors such as tocilizumab, inhibitors of Janus kinases (JAKs, such as tofacitinib), abatacept, and corticosteroids, among others.

It is further contemplated that the combination of the IL-10 mutein, IL-10 mutein plus antigen binding protein, either in separate composition or in a fusion protein, increases the Therapeutic Index (TI) of IL-10 as an anti-inflammatory medication. In various embodiments, the TI of IL-10 mutein is increased by at least 2, 3, 4, 5, 6, 7, 8, 9, 10-fold or more when administered alone or in combination with an antigen binding protein of the disclosure.

In various embodiments, the IL-10 mutein reduces the suppression of TNF-α production in myeloid cells, reduces levels of CD8+ T cell stimulation, and/or reduces the level of B cell stimulation compared to wt IL-10. In various embodiments, the IL-10 mutein antigen binding protein suppresses TNF-α production in myeloid cells. In various embodiments, the IL-10 mutein antigen binding protein suppresses TNF-α production in myeloid cells, while reduc-ing CD8+ T cell and B cell activation.

In certain embodiments, measurement of TNF-α suppres-sion is carried out using isolated PBMC. PBMC are isolated from blood of a subject (human, mouse, rat, cynomolgus monkey, and the like), stimulated in vitro with LPS and levels of TNFα before and after stimulation, and in the presence of different test molecules, are determined using, for examples an ELISA ALPHALISA or MSD Vplex TNFα detection kit.

In certain embodiments, measurement of CD8+ T cell and/or B cell activation is carried out using a whole blood assay. Whole blood is isolated from a subject, stimulated in vitro in the presence of different test molecules and levels of CD8+ T cell stimulation or levels of B cell activation determined, for example, by detection of pSTAT3 levels in the samples by FACS assay.

Administration and Dosing

Methods of the present disclosure include a step of administering a pharmaceutical composition comprising an IL-10 mutein, antigen binding protein or antigen binding protein comprising an antigen binding moiety and an IL-10 moiety as described herein. In certain embodiments, the pharmaceutical composition is a sterile composition.

The amounts of therapeutic composition in a given dosage may vary according to the size of the individual to whom the therapy is being administered as well as the characteristics of the disorder being treated.

The present disclosure provides a composition compris-ing an IL-10 mutein, an antigen binding protein or antibody of the disclosure, or an antigen binding protein comprising an antigen binding moiety and an IL-10 moiety as described herein and a pharmaceutically acceptable carrier. A pharma-ceutical composition comprising an IL-10 mutein, an anti-gen binding protein or antibody of the disclosure, or antigen binding protein comprising an antigen binding moiety and an IL-10 moiety as described herein can be formulated according to known methods to prepare pharmaceutically useful compositions, whereby the therapeutic antibodies are combined in a mixture with a pharmaceutically acceptable carrier. A composition is said to comprise a "pharmaceuti-cally acceptable carrier" if its administration can be tolerated by a recipient patient. Sterile phosphate-buffered saline is one example of a pharmaceutically acceptable carrier. Other suitable carriers are well-known to those in the art. See, for example, Getman), ed., *Remington's Pharmaceutical Sci-ences,* 19th Edition, Mack Publishing Company (1995).

For pharmaceutical use, polypeptides of the present dis-closure are formulated for parenteral, particularly intrave-nous or subcutaneous, delivery according to conventional methods. Intravenous administration may be by bolus injec-tion, controlled release, e.g., using mini-pumps or other appropriate technology, or by infusion over a typical period of one to several hours. In general, pharmaceutical formu-lations will include an IL-10 mutein, an antigen binding protein or antibody of the disclosure, or antigen binding protein comprising an anti-TREM-1 moiety and IL-10 moi-ety described herein in combination with a pharmaceutically acceptable carrier, such as saline, buffered saline, 5% dex-trose in water or the like. Formulations may further include one or more excipients, preservatives, solubilizers, buffering agents, albumin to prevent protein loss on vial surfaces, etc. When utilizing such a combination therapy, the IL-10 mutein, antigen binding protein or antibody of the disclo-sure, or antigen binding protein comprising an anti-TREM-1 moiety and IL-10 moiety described herein, may be com-bined in a single formulation or may be administered in separate formulations. Methods of formulation are well known in the art and are disclosed, for example, in Gennaro, ed., *Remington's Pharmaceutical Sciences,* Mack Publish-ing Co., Easton Pa. (1990), which is incorporated herein by reference. Therapeutic doses will generally be in the range of 0.1 to 100 mg/kg of patient weight per day, preferably 0.5-20 mg/kg per day, with the exact dose determined by the clinician according to accepted standards, taking into account the nature and severity of the condition to be treated, patient traits, etc. Determination of dose is within the level of ordinary skill in the art. More commonly, the antibodies will be administered over one week or less, often over a period of one to three days. Generally, the dosage of administered antibodies will vary depending upon such factors as the patient's age, weight, height, sex, general medical condition and previous medical history. Typically, it is desirable to provide the recipient with a dosage of antibodies which is in the range of from about 1 μg/kg to 10 mg/kg (amount of agent/body weight of patient), although a lower or higher dosage also may be administered as circum-stances dictate.

Administration of an IL-10 mutein, an antigen binding protein or antibody of the disclosure, or antigen binding protein comprising an antigen binding moiety and an IL-10 moiety described herein to a subject can be intravenous, intraarterial, intraperitoneal, intramuscular, subcutaneous, intrapleural, intrathecal, by perfusion through a regional catheter, or by direct intralesional injection. In various embodiments the administration is intravenous or subcuta-neous. When administering IL-10 muteins, antigen binding proteins or antigen binding proteins comprising an antigen binding moiety and an IL-10 moiety by injection, the administration may be by continuous infusion or by single or multiple boluses.

Additional routes of administration include oral, mucosal-membrane, pulmonary, and transcutaneous. Oral delivery is suitable for polyester microspheres, zein microspheres, proteinoid microspheres, polycyanoacrylate microspheres, and lipid-based systems (see, for example, DiBase et al., "Oral Delivery of Microencapsulated Proteins", in Sanders et al., eds., *Protein Delivery: Physical Systems*, pp. 255-288, Plenum Press (1997)). The feasibility of an intranasal delivery is exemplified by such a mode of insulin administration (see, for example, Hinchcliffe et al., *Adv. Drug Deliv. Rev.*, 35:199 (1999)). Dry or liquid particles comprising antibodies of the invention can be prepared and inhaled with the aid of dry-powder dispersers, liquid aerosol generators, or nebulizers (e.g., Pettit et al., *TIBTECH*, 16:343 (1998); Patton et al., *Adv. Drug Deliv. Rev.*, 35:235 (1999)). This approach is illustrated by the AERX® diabetes management system, which is a hand-held electronic inhaler that delivers aerosolized insulin into the lungs. Studies have shown that proteins as large as 48,000 kDa have been delivered across skin at therapeutic concentrations with the aid of low-frequency ultrasound, which illustrates the feasibility of transcutaneous administration (Mitragotri et al., *Science,* 269:850 (1995)).

For purposes of therapy, compositions comprising an IL-10 mutein, an antigen binding protein or antibody of the disclosure, or an antigen binding protein comprising an antigen binding moiety and an IL-10 moiety described herein and a pharmaceutically acceptable carrier are administered to a patient in a therapeutically effective amount. A combination of an IL-10 mutein, antigen binding protein or antibody of the disclosure, or antigen binding protein comprising an antigen binding moiety and an IL-10 moiety described herein and a pharmaceutically acceptable carrier is said to be administered in a "therapeutically effective amount" if the amount administered is physiologically significant. An agent is physiologically significant if its presence results in a detectable change in the physiology of a recipient patient. For example, an agent used to treat inflammation is physiologically significant if its presence alleviates the inflammatory response. Effective treatment may be assessed in a variety of ways. In one embodiment, effective treatment is determined by reduced inflammation. In other embodiments, effective treatment is marked by inhibition of inflammation. In still other embodiments, effective therapy is measured by increased well-being of the patient including such signs as weight gain, regained strength, decreased pain, thriving, and subjective indications from the patient of better health.

The amounts of IL-10 mutein in a given dosage may vary according to the size of the individual to whom the therapy is being administered as well as the characteristics of the disorder being treated. The dose of IL-10 mutein administered is in the range of about 0.05 mg/kg to 1 mg/kg, or about 0.05 to 0.5 mg/kg. In various embodiments, the IL-10 mutein when fused with TREM-1 antibody as described herein is in a dose of about 0.05 mg/kg, 0.1 mg/kg, 0.15 mg/kg, 0.2 mg/kg, 0.25 mg/kg, 0.3 mg/kg, 0.4 mg/kg, 0.5 mg/kg, 0.6 mg/kg, 0.75 mg/kg, or 1.0 mg/kg, or when given as a weight amount administered in a dose of about 1.0 μg-50 μg, or about 1.0 μg, 3.0 μg, 5.0 μg, 7.5 μg, 10 μg.

It is contemplated that the antigen binding protein or antigen binding protein comprising an antigen binding moiety and an IL-10 moiety, e.g., comprising anti-TREM-1 antibody sequences, is administered at a dose of 30 mg, 40 mg, 50 mg, 60 mg, 70 mg, 80 mg, 90 mg, 100 mg, 125 mg, 150 mg, 200 mg, 250 mg, 300 mg or more. the IL-10 mutein or antigen binding protein can be formulated at a concentration of 30 mg/ml, 40 mg/ml, 50 mg/ml, 60 mg/ml, 70 mg/ml, 80 mg/ml, 90 mg/ml, 100 mg/ml, 125 mg/ml, 150 mg/ml, 200 mg/ml, or 250 mg/ml. In various embodiments, antigen binding protein or fusion protein, e.g., comprising anti-TREM-1 antibody sequences, is administered at a dose of about 0.05 mg/kg, 0.25 mg/kg, 0.5 mg/kg, 0.75 mg/kg, 1.0 mg/kg, 1.25 mg/kg, 1.5 mg/kg, 2.0 mg/kg, 2.5 mg/kg, 3.0 mg/kg, 3.5 mg/kg, 4.0 mg/kg, 4.5 mg/kg or 5 mg/kg.

Compositions described herein are administered once weekly, twice weekly, once every two weeks, once every three weeks, once every 4 weeks, once monthly, once every 3 months, or once every six months.

A pharmaceutical composition comprising an IL-10 mutein, an antigen binding protein or antibody of the disclosure, or an antigen binding protein comprising an antigen binding moiety and an IL-10 moiety as described herein can be furnished in liquid form, in an aerosol, or in solid form. Liquid forms, are illustrated by injectable solutions and oral suspensions. Exemplary solid forms include capsules, tablets, and controlled-release forms. The latter form is illustrated by miniosmotic pumps and implants (Bremer et al., *Pharm. Biotechnol.,* 10:239 (1997); Ranade, "Implants in Drug Delivery", in Ranade et al., eds., *Drug Delivery Systems*, pp. 95-123, CRC Press (1995); Bremer et al., "Protein Delivery with Infusion Pumps", in Sanders et al., eds., *Protein Delivery: Physical Systems*, pp. 239-254, Plenum Press (1997); Yewey et al., "Delivery of Proteins from a Controlled Release Injectable Implant", in Sanders et al., eds., *Protein Delivery: Physical Systems*, pp. 93-117, Plenum Press (1997).

The formulation can also contain more than one active compound as necessary for the particular indication being treated, preferably those with complementary activities that do not adversely affect each other. Alternatively, or in addition, the composition can comprise an agent that enhances its function, such as, for example, a cytotoxic agent, cytokine, chemotherapeutic agent, or growth-inhibitory agent. Such molecules are suitably present in combination in amounts that are effective for the purpose intended.

In one embodiment, an IL-10 mutein, an antigen binding protein or antibody of the disclosure, or antigen binding protein comprising an antigen binding moiety and an IL-10 moiety as described herein is administered in combination therapy, i.e., combined with other agents, e.g., therapeutic agents, that are useful for treating pathological conditions or disorders, such as autoimmune disorders and inflammatory diseases. The term "in combination" in this context means that the agents are given substantially contemporaneously, either simultaneously or sequentially. If given sequentially, at the onset of administration of the second compound, the first of the two compounds is preferably still detectable at effective concentrations at the site of treatment.

It is contemplated the therapeutic agents of the present disclosure may be given simultaneously, in the same formulation. It is further contemplated that the agents are administered in a separate formulation and administered concurrently, with concurrently referring to agents given within 30 minutes of each other. It is further contemplated that a second agent may be given simultaneously.

In another aspect, an IL-10 mutein is administered prior to administration of the antigen binding protein composition. Prior administration refers to administration of an agent within the range of one week prior to treatment with the other agent, up to 30 minutes before administration of the other agent. It is further contemplated that an agent is administered subsequent to administration of another composition or agent. Subsequent administration is meant to describe administration from 30 minutes after antibody treatment up to one week after antibody administration, e.g., 30 minutes, 1 hour 2 hours, 4 hours, 1 day, 2 days, etc. It is further contemplated that a second For example, the combination therapy can include one or more IL-10 mutein, antigen binding protein or antibody of the disclosure, or antigen binding protein comprising an antigen binding moiety and an IL-10 moiety described herein co-formulated with, and/or co-administered with, one or more additional therapeutic agents, e.g., one or more cytokine and growth factor inhibitors, immunosuppressants, anti-inflammatory agents, metabolic inhibitors, enzyme inhibitors, and/or cytotoxic or cytostatic agents.

Therapeutic agents used in combination with an IL-10 mutein, an antigen binding protein or antibody of the disclosure, or antigen binding protein comprising an antigen binding moiety and an IL-10 moiety described herein include agents that interfere at different stages in an inflammatory response. In one embodiment, an IL-10 mutein, an antigen binding protein or antibody of the disclosure, or antigen binding protein comprising an antigen binding moiety and an IL-10 moiety as described herein may be co-formulated with, and/or co-administered with, one or more additional agents such as other cytokine or growth factor antagonists (e.g., soluble receptors, peptide inhibitors, small molecules, ligand fusions); or antibodies or antigen binding fragments thereof that bind to other targets (e.g., antibodies that bind to other cytokines or growth factors, their receptors, or other cell surface molecules); and anti-inflammatory cytokines or agonists thereof. Non-limiting examples of the agents that can be used in combination with the antibodies described herein, include, but are not limited to, antagonists of one or more interleukins (ILs) or their receptors, e.g., antagonists of IL-1, IL-2, IL-6, IL-7, IL-8, IL-12, IL-13, IL-15, IL-16, IL17A-F, IL-18, IL-20, IL-21, IL-22, IL-23 IL-25, IL-31, IL-32, IL-33; antagonists of cytokines or growth factors or their receptors, such as, LT, EMAP-II, GM-CSF, FGF and PDGF. Antibodies of the invention can also be combined with inhibitors of e.g., antibodies to, cell surface molecules such as CD2, CD3, CD4, CD8, CD20 (e.g., the CD20 inhibitor rituximab (RITUXAN®), CD25, CD28, CD30, CD40, CD45, CD69, CD80 (B7.1), CD86 (B7.2), CD90, or their ligands, including CD154 (gp39 or CD40L), or LFA-1/ICAM-1 and VLA-4/VCAM-1 (Yusuf-Makagiansar et al., *Med. Res. Rev.,* 22:146-167 (2002)). Exemplary antagonists that can be used in combination include antagonists of IL-1, IL-6, IL-12, TNFα, IL-15, IL-18, IL-20, IL-22, IL-23 and IL-31.

In other embodiments, one or more IL-10 muteins, antigen binding proteins or antigen binding proteins comprising an antigen binding moiety and an IL-10 moiety of the disclosure can be co-formulated with, and/or co-administered with, one or more anti-inflammatory drugs, immunosuppressants, or metabolic or enzymatic inhibitors. Non-limiting examples of the drugs or inhibitors that can be used in combination with the antibodies described herein, include, but are not limited to, one or more of: nonsteroidal anti-inflammatory drug(s) (NSAIDs), e.g., ibuprofen, tenidap, naproxen, meloxicam, piroxicam, diclofenac, and indomethacin; sulfasalazine; corticosteroids such. as prednisolone; cytokine suppressive anti-inflammatory drug(s) (CSAIDs); inhibitors of nucleotide biosynthesis, e.g., inhibitors of purine biosynthesis, folate antagonists (e.g., methotrexate (N-[4-[[(2,4-diamino-6-pteridinyl)methyl]methyl-amino]benzoyl]-glutamic acid); and inhibitors of pyrimidine biosynthesis, e.g., dihydroorotate dehydrogenase (DHODH) inhibitors. Preferred therapeutic agents for use in combination with one or more antibodies, e.g., bispecific antibodies, of the invention include NSAIDs, CSAIDs, (DHODH) inhibitors (e.g., leflunomide), and folate antagonists (e.g., methotrexate.

Additional inhibitors include one or more of: corticosteroids (oral, inhaled and local injection); immunosuppressants, e.g., cyclosporin, tacrolimus (FK-506); and mTOR inhibitors, e.g., sirolimus (rapamycin—RAPAMUNE® or rapamycin derivatives, e.g., soluble rapamycin derivatives (e.g., ester rapamycin derivatives, e.g., CCI-779); agents which interfere with signaling by proinflammatory cytokines such as IL-1 (e.g., IRAK, NIK, IKK, p38 or MAP kinase inhibitors); COX2 inhibitors, e.g., celecoxib, rofecoxib, and variants thereof; phosphodiesterase inhibitors, e.g., R973401 (phosphodiesterase Type IV inhibitor); phospholipase inhibitors, e.g., inhibitors of cytosolic phospholipase 2 (cPLA2) (e.g., trifluoromethyl ketone analogs); inhibitors of vascular endothelial cell growth factor or growth factor receptor, e.g., VEGF inhibitor and/or VEGF-R inhibitor; and inhibitors of angiogenesis. Preferred therapeutic agents for use in combination with an IL-10 mutein, an antigen binding protein or antibody of the disclosure, or a antigen binding protein comprising an anti-TREM-1 moiety and IL-10 moiety described herein are immunosuppressants, e.g., cyclosporin, tacrolimus (FK-506); mTOR inhibitors, e.g., sirolimus (rapamycin) or rapamycin derivatives, e.g., soluble rapamycin derivatives (e.g., ester rapamycin derivatives, e.g., CCI-779); COX2 inhibitors, e.g., celecoxib and variants thereof; and phospholipase inhibitors, e.g., inhibitors of cytosolic phospholipase 2 (cPLA2), e.g., trifluoromethyl ketone analogs.

Kits

The disclosure also contemplates a kit comprising one or more containers that comprises an IL-10 mutein, an antigen binding protein or antibody of the disclosure, or a antigen binding protein comprising an antigen binding moiety and an IL-10 moiety as described herein, optimally in a pharmaceutically acceptable carrier or composition. The IL-10 mutein, antigen binding protein or antibody of the disclosure, or antigen binding protein comprising an antigen binding moiety and an IL-10 moiety described herein can be provided in the form of an injectable solution for single or multiple doses, as a unit dose, or as a sterile powder that will be reconstituted before injection. Alternatively, such a kit can include a dry-powder disperser, liquid aerosol generator, or nebulizer for administration of the therapeutic agent(s). Such a kit may further comprise instructions and written information on indications and usage of the pharmaceutical composition.

Syringes, e.g., single use or pre-filled syringes, sterile sealed containers, e.g. vials, bottle, vessel, and/or kits or packages comprising any of the foregoing IL-10 muteins, antigen binding proteins or antigen binding protein comprising an anti-TREM-1 moiety and IL-10 moiety or compositions, optionally with suitable instructions for use, are also contemplated.

In a further embodiment, the invention provides an article of manufacture, or unit dose form, comprising: (a) a composition of matter comprising an IL-10 mutein, an antigen binding protein or antibody of the disclosure, or a antigen binding protein comprising an anti-TREM-1 moiety and IL-10 moiety described herein; (b) a container containing said composition; and (c) a label affixed to said container, or a package insert included in said container referring to the use of said antibody in the treatment of an immune related disease.

In another aspect, the composition or kit comprises a further active ingredient, which may, for example, be a further antibody or an anti-inflammatory, cytotoxic or other agent described herein. Preferably, the composition is sterile.

EXAMPLES

Example 1-Generation of IL-10 Muteins

It was hypothesized herein that IL-10 muteins that exhibit differential binding to IL-10R1/R2 compared to wild type IL-10 and exhibit differential immune stimulating activity would be useful as an immunotherapy.

A stable IL-10 monomer, IL-10M1, was made by inserting a 6 amino acid linker (GGGSGG) (SEQ ID NO: 2676) between loops D and E of IL-10 (Josephson et al., J. Biol. Chem, 275: 13552-13557, 2000). IL-10M1 was modeled onto the structure of hIL-10/IL-10R1. 24 residues of hIL-10 are involved in the binding interface, and there are two interaction surfaces, Site Ia-Helix F and the AB loop of IL-10 and L2-L4 of IL-10R1, and Site Ib-N-terminus of helix A and C-terminus of helix F of IL-10, L5-L6 of IL-10R1.

An IL-10 mutagenesis algorithm was developed based on the structural difference between viral IL-10 (83% homology) and cynomolgus monkey (cyno) IL-10. To facilitate correct folding of IL-10 when fused in a fusion protein, e.g., to an antibody, IL-10M1 was used as a scaffold for mutein design to allow for the last two α-helices to fold onto the N-terminal globular domain and form a functional monomer. A combination of structure and sequence analysis described below was used to help focus potential residues for mutations. To narrow down the size of the mutein panel, ΔΔG binding energy calculations were used to determine mutations that would have the most destabilizing effect on the receptor interface.

The algorithm utilized sequences, mutations, and known structures of IL-10 and IL-10/IL-10R1, focusing on residues with sidechains facing the interface, and maximizing mutation diversity in site Ib. Single point mutations were screened, but Trp, Phe, Pro (with exceptions), or Cys residues were not mutated. Sequence diversity was maximized by selecting at least one mutation in each of the residues on the binding surface Additional strategies include, mutating each residue in the AB loop to Gly or Pro to favor disordered conformation, selecting conservative mutations in the CD loop, including truncations to N-terminal and C-terminal flexible loops, and taking advantage of energy calculations (i.e., ΔΔG binding) to narrow down the mutation panel.

A total of 235 mutations were made and screened. Mutations in the following residues were investigated for binding to IL-10 R1: P20, L23, R24, R27, D28, K34, T35, Q38, M39, K40, D41, Q42, L43, D44, N45, L46, L47, L48, K49, N82, Q83, D84, P85, D86, I87, K138, S141, E142, D144, I145, or E151. N-terminal and C-terminal truncations were also included in the panel in case they altered IL-10 activity. Numbering of the mutants in based on SEQ ID NO: 2, which is wild type human IL-10 lacking the 18 amino acid signal peptide.

Mutations made and selected for further analysis include: AB loop, D41G, L46K; Site Ia, Q38E (helix A), Q38R (helix A), K34D (helix A), K138L (helix F), K138D (helix F); Site Ib, R27L (helix A). Each of these muteins also included a GGGSGG (SEQ ID NO:2676) linker between Helix D and E of IL-10. Exemplary sequences are shown in Table 1.

TABLE 1

| IL-10 Mutein Sequences | | | |
| --- | --- | --- | --- |
| Mutein | Description | Sequence | SEQ ID NO: |
| Human IL-10 | Wildtype (wt) IL-10 (Without signal peptide) | SPGQGTQSENSCTHFPGNLPNMLRDLRDAFSRVKTF FQMKDQLDNLLLKESLLEDFKGYLGCQALSEMIQFYL EEVMPQAENQDPDIKAHVNSLGENLKTLRLRLRRCH RFLPCENKSKAVEQVKNAFNKLQEKGIYKAMSEFDIFI NYIEAYMTMKIRN | 2 |
| IL-10 M1 | IL-10 with GGGSGG (SEQ ID NO: 2676) linker between loops D and E | SPGQGTQSENSCTHFPGNLPNMLRDLRDAFSRVKTF FQMKDQLDNLLLKESLLEDFKGYLGCQALSEMIQFYL EEVMPQAENQDPDIKAHVNSLGENLKTLRLRLRRCH RFLPCENGGGSGGKSKAVEQVKNAFNKLQEKGIYKA MSEFDIFINYIEAYMTMKIRN | 2211 |
| R27L | IL-10 M1 with R27L | SPGQGTQSENSCTHFPGNLPNMLRDLLDAFSRVKTF FQMKDQLDNLLLKESLLEDFKGYLGCQALSEMIQFYL EEVMPQAENQDPDIKAHVNSLGENLKTLRLRLRRCH RFLPCENGGGSGGKSKAVEQVKNAFNKLQEKGIYKA MSEFDIFINYIEAYMTMKIRN | 3 |
| K138L | IL-10 M1 with K138L | SPGQGTQSENSCTHFPGNLPNMLRDLRDAFSRVKTF FQMKDQLDNLLLKESLLEDFKGYLGCQALSEMIQFYL EEVMPQAENQDPDIKAHVNSLGENLKTLRLRLRRCH RFLPCENGGGSGGKSKAVEQVKNAFNKLQEKGIYLA MSEFDIFINYIEAYMTMKIRN | 4 |

TABLE 1-continued

IL-10 Mutein Sequences

| Mutein | Description | Sequence | SEQ ID NO: |
|---|---|---|---|
| K138D | IL-10 M1 with K138D | SPGQGTQSENSCTHFPGNLPNMLRDLRDAFSRVKTF FQMKDQLDNLLLKESLLEDFKGYLGCQALSEMIQFYL EEVMPQAENQDPDIKAHVNSLGENLKTLRLRLRRCH RFLPCENGGGSGGKSKAVEQVKNAFNKLQEKGIYDA MSEFDIFINYIEAYMTMKIRN | 5 |
| D41G | IL-10 M1 with D41G | SPGQGTQSENSCTHFPGNLPNMLRDLRDAFSRVKTF FQMKGQLDNLLLKESLLEDFKGYLGCQALSEMIQFYL EEVMPQAENQDPDIKAHVNSLGENLKTLRLRLRRCH RFLPCENGGGSGGKSKAVEQVKNAFNKLQEKGIYKA MSEFDIFINYIEAYMTMKIRN | 6 |
| Q38R | IL-10 M1 with Q38R | SPGQGTQSENSCTHFPGNLPNMLRDLRDAFSRVKTF FRMKDQLDNLLLKESLLEDFKGYLGCQALSEMIQFYL EEVMPQAENQDPDIKAHVNSLGENLKTLRLRLRRCH RFLPCENGGGSGGKSKAVEQVKNAFNKLQEKGIYKA MSEFDIFINYIEAYMTMKIRN | 7 |
| L46K | IL-10 M1 with L46K | SPGQGTQSENSCTHFPGNLPNMLRDLRDAFSRVKTF FQMKDQLDNKLLKESLLEDFKGYLGCQALSEMIQFYL EEVMPQAENQDPDIKAHVNSLGENLKTLRLRLRRCH RFLPCENGGGSGGKSKAVEQVKNAFNKLQEKGIYKA MSEFDIFINYIEAYMTMKIRN | 8 |
| K34D | IL-10 M1 with K34D | SPGQGTQSENSCTHFPGNLPNMLRDLRDAFSRVDTF FQMKDQLDNLLLKESLLEDFKGYLGCQALSEMIQFYL EEVMPQAENQDPDIKAHVNSLGENLKTLRLRLRRCH RFLPCENGGGSGGKSKAVEQVKNAFNKLQEKGIYKA MSEFDIFINYIEAYMTMKIRN | 9 |
| Q38E | IL-10 M1 with Q38E | SPGQGTQSENSCTHFPGNLPNMLRDLRDAFSRVKTF FEMKDQLDNLLLKESLLEDFKGYLGCQALSEMIQFYL EEVMPQAENQDPDIKAHVNSLGENLKTLRLRLRRCH RFLPCENGGGSGGKSKAVEQVKNAFNKLQEKGIYKA MSEFDIFINYIEAYMTMKIRN | 10 |

In addition to the mutational analysis, different size linkers inserted between the D and E helix were generated. Rosetta Remodel (Huang et al., *PLoS One*. 2011; 6(8): e24109) was used to model protein structure upon insertion of different amino acids in the helix structure of IL-10, including 3-mers, 4-mers, 5-mers and 6-mers. GS linkers scored well in models. Modeled linker sequences are set out in Table 2.

TABLE 2

Linkers for IL-10 Muteins

| GSG | NPG | GGGG (SEQ ID NO: 2677) | RPTG (SEQ ID NO: 2678) | SGSSG (SEQ ID NO: 2679) | GATGK (SEQ ID NO: 2680) |
|---|---|---|---|---|---|
| GSG | GGG | GGGG (SEQ ID NO: 2677) | VPAR (SEQ ID NO: 2681) | SSSSG (SEQ ID NO: 2682) | SSSPG (SEQ ID NO: 2683) |
| GSG | GGG | SSGG (SEQ ID NO: 2684) | GKTG (SEQ ID NO: 2685) | SSSSG (SEQ ID NO: 2682) | GSGTG (SEQ ID NO: 2686 ) |
| SGG | KGT | GGGG (SEQ ID NO: 2677) | GGAG (SEQ ID NO: 2687) | GSSSG (SEQ ID NO: 2688) | RPKAT (SEQ ID NO: 2689) |
| GSG | GNG | SGSG (SEQ ID NO: 2690 ) | GGGG (SEQ ID NO: 2677) | SSSGG (SEQ ID NO: 2991) | GSSSG (SEQ ID NO: 2688) |
| SGS | GNG | SGGG (SEQ ID NO: 2692) | NAGG (SEQ ID NO: 2693) | GSSSG (SEQ ID NO: 2688) | KPGST (SEQ ID NO: 2694) |
| GGG | RGS | SGGG (SEQ ID NO: 2692 ) | RPSG (SEQ ID NO: 2695) | SGSGG (SEQ ID NO: 2696) | KGGKG (SEQ ID NO: 2697) |
| SSG | SGG | GGSS (SEQ ID NO: 2698 ) | KPTG (SEQ ID NO: 2699) | GGGGS (SEQ ID NO: 2725) | GGGSS (SEQ ID NO: 2700) |
| GGS | TTS | GSSS (SEQ ID NO: 2701) | GGGG (SEQ ID NO: 2677) | GSSSG (SEQ ID NO: 2688) | GKKAT (SEQ ID NO: 2702) |

TABLE 2-continued

| Linkers for IL-10 Muteins | | | | | |
|---|---|---|---|---|---|
| GGG | KKG | GGSS (SEQ ID NO: 2698) | RSSG (SEQ ID NO: 2703) | SGSGG (SEQ ID NO: 2696) | AKVGS (SEQ ID NO: 2704) |

Table 3 shows inhibition of LIPS induced TNF in 293 cells by select IL-10 muteins and IL-10 mutein fusion with anti-TREM-1 antibody 1B12. The heavy chain of the fusion molecules have the sequences identified; the light chain sequence of each is that of antibody 1Bi12 (SEQ ID NO: 2185).

TABLE 3

| LPS Inhibition by IL-10 Muteins and anti-TREM-1 Antibody 1B12 | | | | |
|---|---|---|---|---|
| IL-10 variants | Fc-IL-10mutein EC50 PM | Fold reduced potency compared to wt IL-10 | 1B12/IL-10mutein EC50 pM | SEQ ID NO of IL-10 fusion AA with Ab 1B12 HC |
| Wt IL-10 | 0.84 | | NA | |
| R27L | 1874 | 2231 | 285.8 | 2199 |
| K138L | NA | NA | 24.6 | 2201 |
| K138D | NA | NA | 54.4 | 2203 |
| D41G | NA | NA | 8.2 | 2205 |
| Q38R | NA | NA | 2.64 | 2207 |
| L46K | 1229 | 1463 | 2.24 | 2209 |
| K34D | 367 | 436 | 0.3329 | 2211 |
| Q38E | 112 | 133 | 0.063 | 2213 |
| D144I | NA | NA | NA | 2215 |
| D144S | NA | NA | NA | 2217 |
| E142Q | NA | NA | NA | 2219 |
| IL10M1 | NA | NA | NA | 2221 |
| TREM1-1B12(v503KK)-huIL10(Q38E) | NA | NA | NA | 2223 |
| TREM1-1B12_(v503DD)-huIL10(Q38E) | NA | NA | NA | 2225 |
| TREM1-1B12_(v503KK)-huIL10M1 | NA | NA | NA | 2227 |
| TREM1-1B12_(v503DD)-huIL10M1 | NA | NA | NA | 2229 |
| TREM1-1B12_(C42S, S249G) | NA | NA | NA | 2231 |

A goal of the IL-10 muteins is to retain/restore IL-10 suppression activity on monocytes and macrophages and reduce IL-10 stimulation of CD8+ T cells and B cells.

Example 2-Anti-TREM-1 Antibodies

It was considered that to prolong the half-life and activity of IL-10, fusing it to a cell surface targeting moiety would be beneficial. High affinity anti-TREM-1 monoclonal antibodies were generated and assessed for the ability to target IL-10 to immune cells and extend the half-life of IL-10.

Fully human antibodies to human TREM-1 were generated by immunizing XENOMOUSE® transgenic mice. See for example, U.S. Pat. Nos. 6,114,598; 6,162,963; 6,833, 268; 7,049,426; and 7,064,244.

Mice were immunized with human and/or cyno TREM1 protein, TREM1 expression vectors and/or TREM1 expressing CHO cells. For genetic immunizations, mice were immunized 16 times over 8 weeks using the HELIOS® Gene Gun system according to the manufacturer's instructions (BioRad, Hercules, California). Briefly, expression vectors encoding either human TREM-1 and DAP12, or cyno TREM-1 and DAP12, were pooled and 2 μg total DNA were coated onto 1.6 um gold beads (BioRad, Hercules, California) and delivered to the epidermis of a shaved mouse abdomen. For soluble protein immunizations, mice were immunized with human or cyno TREM-1 recombinant protein representing the N-terminal extracellular domain. Animals were immunized with recombinant protein adjuvanted with either Alum and CpG-ODN or Sigma Adjuvant System, 14-17 times over 10-12 weeks using sub-cutaneous injections delivered at two locations along the dorsal midline of the mice located at the base of tail and subscapular region. The initial soluble protein immunization delivered 10 μg and subsequent boosts were 5 μg. For cell immunizations, mice were immunized with 2-4 million CHO-S cells transiently expressing either human TREM-1 or cyno TREM-1 adjuvanted with Alum and CpG-ODN. Animals were immunized 1 or 2 times weekly for a total of 13 times over 10 weeks alternating between intraperitoneal and subcutaneous injections at the base of tail. Animals were bled, and plasma collected at various time points during the immunization studies ranging from 4 weeks to 10 weeks to assess for TREM1-specific titers. TREM1-specific plasma titers were monitored by live-cell FACS analysis on an ACCURI™ flow cytometer (BD Biosciences), using transiently transfected 293T cells. Animals with the highest antigen-specific plasma titers against human and cyno TREM1 were sacrificed and used for hybridoma generation (Kohler and Milstein, 1975)

Hybridoma Generation: Animals exhibiting suitable antigen-specific serum titers were identified and spleen and/or draining lymph nodes from select mice were pooled from each harvest. Splenocytes and lymphocytes were dissociated from lymphoid tissue by grinding in a suitable medium or using the GENTLEMACS™ Dissociator (Miltenyi Biotec) semi-automated tissue dissociation instrument. IgG-expressing B cells were isolated, expanded using standard methods, and fused with a suitable cell fusion partner. Hybridoma supernatants were tested for binding to human TREM-1 transiently expressed on HEK293 cells by CELLINSIGHT™. Briefly, HEK293 cells were transiently co-transfected with a 1:1 ratio of mammalian expression constructs encoding human TREM-1 and DAP12, or mock vector and DAP12 alone using 293Fectin (Invitrogen) following the manufacturer's protocol. The following day, 15,000 cells/well of transfected HEK293 cells were combined with an equal volume of exhausted hybridoma media test samples and nuclear stain Hoechst 33342 (Pierce) at 15 μg/mL final concentration, at a total volume of 30 μL/well in 384-well FMAT plates (Corning). After 1 hour incubation at room temperature, the supernatant was aspirated using an AQUAMAX® plate washer, and wells were washed for 2 cycles using 50 μL/well of FACS buffer (PBS (Hyclone), 2% FBS (Sigma)) each cycle on the AquaMax. Cells were stained with 5 μg/mL Alexa Fluor 488 Goat anti-Human IgG Fc (Jackson ImmunoResearch) secondary antibody, shaken on a Big Bear plate shaker, and incubated at room temperature for 20 minutes. The supernatant was aspirated using an AQUAMAX® plate washer, wells were again washed for 2 cycles using 50 µL/well of FACS buffer, and 30 µL of FACS buffer was added to each well using a multidrop instrument. The plates were placed on a Big Bear Plate shaker to evenly distribute the cells in the wells, and then read on the CELLINSIGHT™CX7 platform using the Cell Health Profiling Bio-App.

The TREM-1-specific antibodies identified in primary screening were evaluated for cross-reactivity to cynomolgus TREM-1, as well as specificity to TREM-1 and not DAP12. TREM-1 hybridoma supernatants were tested for binding to human or cyno TREM-1 transiently expressed on HEK293 cells by FACS (harvests 1-6) or by CELLINSIGHT™ (harvests 8-9). For TREM1 antibodies from harvests 1-6, HEK293 cells were transiently co-transfected with a 1:1 ratio of mammalian expression constructs encoding human TREM-1 and DAP12, cyno TREM-1 and DAP12, or mock vector and human DAP12 using 293Fectin. The following day, transfected HEK293 cells were transferred into 96-well FACS plates at 50,000 cells/well and incubated with normalized hybridoma supernatants at a final concentration of 2.5 µg/mL for 1 hour at 4° C. Cells were then pelleted by centrifugation, supernatant was removed by flicking, and wells were washed twice with 200 µL/well of FACS buffer. 5 µg/mL ALEXA FLUOR®647 Goat anti-Human IgG Fc (Jackson ImmunoResearch) secondary detection antibody and 2.5 µg/mL 7-aminoactinomycin-D (Sigma) viability stain were incubated with the cells for 15 minutes at 4° C. Cells were pelleted by centrifugation, supernatant was removed by flicking, and wells were washed once more with 200 µL/well of FACS buffer. TREM-1 hybridoma supernatants showing human TREM-1- or cyno TREM-1-specific binding was detected by FACS on the BD ACCURI™ C6 flow cytometer with Intellicyt autosampler. The data was reported as geomean (GM) fold over irrelevant control antibody binding. Results of binding for certain anti-TREM-1 antibodies is shown in Table 4.

TABLE 4

| TREM1 antibodies in human/cyno cross-reactivity and specificity screen | | |
|---|---|---|
| Antibody ID | Human TREM1 GM Fold | Cyno TREM1 GM Fold |
| 3E12 | 279.6 | 176.5 |
| 34D1 | 245.8 | 228.1 |
| 30H2 | 108.1 | 76.9 |
| 44A5 | 1634.6 | 2238.4 |
| 46H7 | 1907.9 | 2688.8 |
| 49A2 | 2218.0 | 2978.4 |
| 50A12 | 2421.0 | 2782.1 |
| 57C10 | 1667.8 | 2429.0 |
| 57F5 | 718.8 | 2338.9 |
| 61B12 | 1850.3 | 2093.4 |
| 61G5 | 2072.8 | 2160.6 |
| 63F8 | 1384.3 | 2372.3 |
| 64D7 | 1476.6 | 2151.3 |
| 66B8 | 1634.0 | 1517.9 |

The TREM1 antibodies demonstrating high quality TREM1-specific binding and human/cyno cross-reactivity were evaluated for their ability to block ligand PGLYRP1 from binding to human TREM1/DAP12 transiently expressed on HEK293 cells. Briefly, HEK293 cells were transiently co-transfected with a 1:1 ratio of mammalian expression constructs encoding human TREM1 and DAP12, or mock vector and human DAP12 using 293Fectin. The following day, transfected HEK293 cells were transferred into 96-well FACS plates at 50,000 cells/well and incubated with normalized hybridoma supernatants at a final concentration of 2.5 µg/mL for 1 hour at 4° C. Human PGLYRP1-His (R&D Systems) was combined with PGN-ECndss (peptidoglycan, InvivoGen) and incubated at room temperature for 15 minutes, then added to the wells at a final concentration of 7.5 µg/mL PGLYRP1 and 30 µg/mL PGN. The plates were then shaken and incubated for 15 minutes at 4° C. Cells were then pelleted by centrifugation, supernatant was removed by flicking, and wells were washed with 200 µL of FACS buffer. 5 µg/mL ALEXA FLUOR®647 human anti-His secondary detection antibody and 2.5 µg/mL 7-aminoactinomycin-D (Sigma) viability stain were added to the cells, shaken, and incubated for 15 minutes at 4° C. Cells were washed with FACS buffer, pelleted by centrifugation, supernatant was removed by flicking, and washed once more with FACS buffer. Cells were then run on the BD ACCURI™C6 Flow Cytometer with Intellicyt HYPERCYT® autosampler. A total of 518 TREM1 antibodies showed the desired specific PGLYRP1-blocking activity. Receptor-ligand inhibition for select TREM-1 monoclonal antibodies are summarized in Table 5.

TABLE 5

| Receptor-ligand inhibition for select TREM1 antibodies | |
|---|---|
| Antibody ID | Receptor-ligand % inhibition |
| 3E12 | 101% |
| 34D1 | 101% |
| 30H2 | 101% |
| 44A5 | 100% |
| 46H7 | 100% |
| 49A2 | 100% |
| 50A12 | 100% |
| 57C10 | 100% |
| 57F5 | 100% |
| 61B12 | 87% |
| 61G5 | 91% |
| 63F8 | 93% |
| 64D7 | 96% |
| 66B8 | 85% |

TREM-1 Antibody Relative Affinity Ranking by Limiting Antigen Assay: TREM1 hybridoma supernatants were affinity-ranked within the panel by their binding kinetics to soluble TREM-1 in a limiting antigen assay using LUMAVIDIN® beads (Luminex) on FACS. Briefly, in-house biotinylated human TREM-1-His antigen (b-huTREM-1-His) was serially diluted in FACS buffer and combined with an equal volume of LUMAVIDIN® beads (different uniquely-barcoded bead for each antigen concentration), resulting in a 5-point 2-fold serial dilution series starting from a final b-huTREM-1-His antigen concentration of 30 ng/mL. The antigen-bead mixtures were plated across 3 wells in a 96-well FACS plate, then incubated for 30 minutes at room temperature protected from light. Beads were then pelleted by centrifugation, supernatant was removed by flicking, and wells were washed twice with 200 µL/well of FACS buffer. The different beads were then resuspended, pooled, and diluted in STABILGUARD® Immunoassay Stabilizer (SurModics) to block non-specific binding. Normalized TREM-1 hybridoma supernatants were combined with an equal volume of bead mixture in a FACS plate at a final concentration of 5 µg/mL test antibody to 0.5 µL beads/well. The plates were then shaken and incubated overnight for ~18 hours at room temperature. Beads were then pelleted by centrifugation, supernatant was removed by flicking, and wells were washed twice with 200 µL/well of FACS buffer. ALEXA FLUOR® 488 Goat anti-Human IgG Fc secondary detection antibody (Jackson ImmunoResearch) was added at 5 µg/mL to the plates, shaken, and incubated for 15 minutes at room temperature protected from light. Beads were washed with FACS buffer, pelleted by centrifugation, supernatant was removed by flicking, and washed once more with FACS buffer. The beads were then resuspended and run on the BD ACCURI™ C6 Flow Cytometer with Intellicyt HYPERCYT® autosampler.

TREM-1 hybridoma samples showing at least two times or greater signal over control IgG antibody samples were considered to be exhibiting TREM-1-specific binding profiles. The antibody binding signal correlates with antibody affinity; the degree of antibody binding to the target antigen TREM-1 correlates with the measured fluorescent intensity and thus allows a relative comparison of affinities across the panel. TREM-1 antibodies with better binding in limiting antigen screens than the benchmark antibody 1B2 were advanced to light chain sequencing and human/cyno affinity gap analysis. Table 6 shows the antibody binding data for select TREM-1 antibodies using a representative antigen coating concentration that fell within the linear range of the instrument signal detection

TABLE 6

Relative affinities of select TREM1 antibodies in limited antigen binding assays

| Antibody ID | Soluble TREM1 7.5 ng/ml (FACS Geomean) |
|---|---|
| 3E12 | 121096 |
| 34D1 | 80444 |
| 30H2 | 91743 |
| 44A5 | 36759 |
| 46H7 | 37975 |
| 49A2 | 28315 |
| 50A12 | 14642 |
| 57C10 | 28498 |
| 57F5 | 25282 |
| 61B12 | 26854 |
| 61G5 | 24835 |
| 63F8 | 25759 |
| 64D7 | 24511 |
| 66B8 | 23784 |

TREM1 Relative Epitope Binning/Profiling: TREM1 hybridoma supernatants were assessed by epitope binning assay (a modified antibody-antibody competition assay) using LUMAVIDIN® beads (Luminex) on FACS to determine the variety of relative unique epitope bins in the panel. Briefly, a set of 15 different uniquely-barcoded LUMAVIDIN® beads were each combined with an equal volume of in-house biotinylated human TREM-1-His antigen diluted in FACS buffer at a final concentration of 100 ng/mL. The antigen-bead mixtures were plated across 3 wells in a 96-well FACS plate, then incubated for 30 minutes at room temperature protected from light. Beads were then pelleted by centrifugation, supernatant was removed by flicking, and wells were washed twice with 200 µL/well of FACS buffer. 15 different TREM-1 antibodies with diverse VDJ rearrangements and good quantitation that had shown good binding in the limiting antigen assay were chosen as reference antibodies for pre-coating the beads. These 15 antibodies were prepared at a saturating concentration of 5 µg/mL in FACS buffer and incubated with each of the 15 different LUMAVIDIN® beads for 1 hour at room temperature protected from light. Beads were pelleted by centrifugation, supernatant was removed by flicking, and wells were washed three times with 200 µL/well of FACS buffer. The different beads were then resuspended, pooled, and diluted in STABILGUARD® Immunoassay Stabilizer (SurModics) to block non-specific binding. Normalized TREM-1 hybridoma supernatants (test antibodies) were combined with an equal volume of bead mixture in a FACS plate at a final concentration of 5 µg/mL test antibody to 0.5 µL beads/well. The plates were then shaken and incubated for 1 hour at room temperature protected from light. Beads were then pelleted by centrifugation, supernatant was removed by flicking, and wells were washed twice with 200 µL/well of FACS buffer. ALEXA FLUOR®488 Goat anti-Human IgG Fc secondary detection antibody (Jackson ImmunoResearch) was added at 5 µg/mL to the plates, shaken, and incubated for 15 minutes at room temperature protected from light. Beads were washed with FACS buffer, pelleted by centrifugation, supernatant was removed by flicking, and washed once more with FACS buffer. The beads were then resuspended and run on the BD ACCURI™ C6 Flow Cytometer with Intellicyt HYPERCYT® autosampler.

Test antibodies competing to a similar epitope on the TREM-1 antigen as the reference antibodies are prevented from binding while non-competing antibodies are able to bind generating an additive signal with the reference antibody. The total bound antibodies are then detected with the secondary antibody. To determine the antibody competition/binding profiles of the individual test antibodies, the reference-only antibody binding signal was subtracted from the reference plus test antibody signal for each competition/binding reaction (i.e., across the entire reference antibody set). A summary of the relative epitope binning for select TREM-1 antibodies is shown below in Table 7.

TABLE 7

Relative epitope bins for select top TREM1 antibodies

| Antibody ID | Epitope Bin |
|---|---|
| 3E12 | B |
| 34D1 | ND |
| 30H2 | ND |
| 44A5 | A |
| 46H7 | A |
| 49A2 | A |
| 50A12 | A.1 |
| 57C10 | A |
| 57F5 | A |
| 61B12 | A |
| 61G5 | A |
| 63F8 | A |
| 64D7 | A |
| 66B8 | A |

TREM1 Antibody Human/Cynomolgus Affinity Gap Determination: TREM-1 antibodies with unique CDR3 sequences that had also shown better binding in limiting antigen screens than the benchmark antibody were analyzed for their affinity to human and cyno TREM-1. The binding affinity $K_D$ (M), association rate constant $k_a$ ($M^{-1}s^{-1}$), and dissociation rate constant $k_d$ ($s^{-1}$), were determined on a panel of 114 TREM-1 antibodies using the OCTET® HTX instrument (Fortebio). Briefly, TREM-1 hybridoma supernatants normalized to 10 µg/mL in DMEM null media were prepared by diluting 1:10 in OCTET® assay buffer (10 mM Tris, 0.1% Triton X-100, 150 mM NaCl, 1 mM CaCl₂, 0.1 mg/mL BSA, at pH 7.6) to a final test concentration of 1 µg/mL. Amine reactive second-generation AR2G Biosensors (Molecular Devices) were pre-incubated in 200 μL nanopore water for a minimum of 10 minutes at room temperature before use. The AR2G Biosensors were then activated for 5 minutes in a solution of 20 mM EDC (1-Ethyl-3-[3-dimethylaminopropyl]carbodiimide hydrochloride) (ForteBio) pre-mixed with 10 mM NHS (N-hydroxysulfosuccinimide) (ForteBio) in nanopore water. An in-house generated mouse anti-human Fc monoclonal antibody was coupled to the AR2G Biosensors at 10 μg/mL in 10 mM sodium acetate buffer at pH 5 for 5 minutes, quenched with 1M ethanolamine at pH 8.5 for 5 minutes, and then used to capture antibody from solution. The TREM-1 test antibodies were loaded onto the Biosensors for 5 minutes, and baseline measurements were taken for 1 minute. The recombinant soluble human TREM-1-His protein was then bound to the antibody-loaded Biosensors in a 3-fold dilution series covering 6 points from 450 nM to 1.85 nM or 150 nM to 0.62 nM. The association of recombinant human TREM-1 with the antibody-loaded sensor was measured for 5 minutes, followed by dissociation in OCTET® buffer for 10 minutes. Biosensors were then regenerated with 10 mM glycine at pH 1.7, reloaded with the same TREM-1 antibodies on the same sensors for 5 minutes, and the same method was used to measure association and dissociation of cyno TREM-1-His protein. Data was referenced using a 0 nM analyte reference sensor. Kinetic analysis was performed using a 1:1 *Langmuir* model with mass transfer in Genedata Screener software. TREM-1 antibodies that met design goals and showed an affinity difference of less than 10-fold between human and cyno TREM-1 were identified, and their binding affinities are displayed in Table 8.

TABLE 8

| | TREM1 antibodies with <10-fold human and cyno TREM-1 affinity gap | | | | | |
|---|---|---|---|---|---|---|
| Antibody | Binding affinity for human TREM1 | | | Binding affinity for cyno TREM1 | | |
| ID | $K_D$ (M) | $k_a$ ($M^{-1}s^{-1}$) | $k_a$ ($s^{-1}$) | $K_D$ (M) | $k_a$ ($M^{-1}s^{-1}$) | $k_a$ ($s^{-1}$) |
| 3E12 | 5.70E−10 | 4.62E+05 | 2.63E−04 | 1.80E−09 | 4.89E+05 | 8.82E−04 |
| 34D1 | 8.81E−10 | 2.33E+05 | 2.05E−04 | 4.97E−09 | 2.58E+05 | 1.28E−03 |
| 30H2 | 8.98E−10 | 3.26E+05 | 2.93E−04 | 5.70E−09 | 2.14E+05 | 1.22E−03 |
| 44A5 | 4.04E−10 | 4.51E+05 | 1.82E−04 | 2.02E−09 | 7.51E+05 | 1.52E−03 |
| 46H7 | 4.57E−10 | 7.37E+05 | 3.36E−04 | 9.93E−10 | 1.14E+06 | 1.13E−03 |
| 49A2 | 7.67E−10 | 3.73E+05 | 2.86E−04 | 1.87E−09 | 7.73E+05 | 1.44E−03 |
| 50A12 | 4.85E−09 | 5.19E+05 | 2.52E−03 | 6.42E−09 | 6.87E+05 | 4.41E−03 |
| 57C10 | 8.24E−10 | 3.04E+05 | 2.51E−04 | 1.28E−09 | 1.87E+05 | 2.40E−04 |
| 57F5 | <2.81E−10* | 6.27E+05 | <1.76E−4* | <2.9E−10* | 6.07E+05 | <1.76E−4* |
| 61B12 | <5.57E−10* | 3.16E+05 | <1.76E−4* | 1.27E−09 | 3.91E+05 | 4.95E−04 |
| 61G5 | <2.85E−10* | 6.18E+05 | <1.76E−4* | 1.31E−09 | 3.64E+05 | 4.76E−04 |
| 63F8 | <2.20E−10* | 7.99E+05 | <1.76E−4* | 8.56E−10 | 7.52E+05 | 6.44E−04 |
| 64D7 | <2.50E−10* | 7.05E+05 | <1.76E−4* | 6.80E−10 | 5.19E+05 | 3.53E−04 |
| 66B8 | 7.98E−09 | 1.71E+05 | 1.36E−03 | 1.64E−09 | 1.54E+05 | 2.53E−04 |

*A < symbol designates that less than 10% of the TREM1 dissociated during the allotted 10-minute dissociation time, indicating that the $k_d$ is <1.76E−4 s⁻¹. The < $K_D$ (M) is calculated based on $k_d$ <1.76E−4 s⁻¹.

Antibodies were selected based on binding to human or cyno TREM-1, lack of binding to TREM2, and their ability to block PGLYRP1 binding to TREM-1. 14 antibodies were selected for further study as set out in Table 9.

TABLE 9

| | | Anti-TREM-1 antibody clones | | | |
|---|---|---|---|---|---|
| ID | Vh | Vlight | HCDR3 | Human KD | Cyno KD |
| 66B8 | VH1\|1-02/D6\|6-6\|RF1/JH5 | VK1\|L5/JK5 | AGYSTSWKDWFDP (SEQ ID NO: 38) | 7.98E−09 | 1.64E−09 |
| 44A5 | VH3\|3-23/D6\|6-6\|RF1/JH4 | VK3\|L2/JK4 | AYYSNYLFDY (SEQ ID NO: 238) | 4.04E−10 | 2.02E−09 |
| 46H7 | | VK3\|L2/JK1 | EFSSNSLFDY (SEQ ID NO: 218) | 4.57E−10 | 9.93E−10 |
| 57F5 | VH3\|3-23/D1\|1-26\|RF3/JH1 | VK1\|O12/JK4 | EGGSNRYFHH (SEQ ID NO: 138) | <2.81E−10 | <2.9E−10 |
| 30H2 | | VK3\|L2/JK1 | VAGSNFFFDH (SEQ ID NO: 258) | 8.98E−10 | 5.70E−09 |
| 3E12 | VH1\|1-02/D1\|1-1\|RF1/JH4 | VL3\|3r/JL2 | DQRKTTVTPFEY (SEQ ID NO: 298) | 5.70E−10 | 1.80E−09 |
| 61B12 | VH1\|1-08/D6\|6-6\|RF1/JH3 | VK1\|O18/JK4 | GGISSSWHWAFDI (SEQ ID NO: 118) | <5.57E−10 | 1.27E−09 |
| 63F8 | VH1\|1-08/D6\|6-13\|RF1/JH4 | VK1\|O18/JK4 | GGRTSIWSFVFDY (SEQ ID NO: 78) | <2.20E−10 | 8.56E−10 |

TABLE 9-continued

| ID | Vh | Vlight | HCDR3 | Human KD | Cyno KD |
|---|---|---|---|---|---|
| | | | Anti-TREM-1 antibody clones | | |
| 57C10 | VH1\|1-08/D6\|6-13\|RF1/JH2 | VK1\|O18/JK4 | GGYTSAWRWYFDL (SEQ ID NO: 158) | 8.24E-10 | 1.28E-09 |
| 34D1 | VH1\|1-08/D3\|3-22\|RF2/JH2 | VK1\|O18/JK5 | GGYTSSWRWYFDL (SEQ ID NO:278) | 8.81E-10 | 4.97E-09 |
| 49A2 | VH3\|3-07/D1\|1-1 \|RF1/JH1 | VK3\|L2/JK4 | GGWRFES (SEQ ID NO: 198) | 7.67E-10 | 1.87E-09 |
| 61G5 | VH1\|1-08/D7\|7-27\|RF1/JH1 | VK1\|O18/JK5 | LIGYSSAWKWSFQH (SEQ ID NO: 98) | <2.85E-10 | 1.31E-09 |
| 64D7 | VH1\|1-08/D6\|6-19\|RF2/JH2 | VK1\|O18/JK4 | RRAVYRSSWEWYFDL (SEQ ID NO: 58) | <2.50E-10 | 6.80E-10 |
| 50A12 | VH3\|3-07/D4\|4-17\|RF2/JH4 | VK1\|L5/JK1 | DYGDSFDY (SEQ ID NO: 178) | 4.85E-09 | 6.42E-09 |

Example 3-Reformatting of Anti-TREM-1 Antibodies

Lead anti-TREM-1 antibodies from the XenoMouse® campaign were converted to an antibody format of the IgG1z subtype by fusing the VL domain of kappa light chains to CK domain, the VL domain of lambda light chains to CL domain, and VH domains to the CH1-CH2-CH3(221-447) sequence. The CH2 domain of this antibody isotype has been engineered for reduced effector function by incorporating an N297G mutation and for improved thermostability through an engineered disulfide bond (R292C, V302C); this antibody isotype is designated IgG1z SEFL2. The lead anti-TREM-1 antibodies were additionally engineered to remove "hotspots," or residues that were computationally predicted or empirically determined to negatively impact the molecule's expression, purification, thermal stability, colloidal stability, long-term storage stability, in vivo pharmacokinetics, and/or immunogenicity. A variety of amino acid mutations at these hotspots were designed based on conservation, co-variation, chemical similarity, predictions from structural modeling, and prior knowledge from other antibody engineering campaigns. A small panel of rationally designed engineered antibodies were designed that included both single mutations and combinations of mutations.

Recombinant expression constructs for the rationally designed panel of hotspot engineered variants were produced using Golden Gate cloning to assemble 1) synthetic DNA fragments comprising the antibody variable domains, 2) previously cloned "parts vectors" containing the necessary constant domains (i.e., CK or CL, CH1-CH2-CH3(118-447) (R292C, N297G, V302C)), and 3) a mammalian expression vector backbone. Heavy chains (HCs) were assembled into a vector backbone with a puromycin selection cassette and light chains (LCs) were assembled into a vector backbone with a hygromycin selection cassette. The HC and LC expression vectors were co-transfected in a 1:1 ratio in CHO-K1 cells using Lipofectamine LTX (Gibco), and stable pools were generated by passaging every 2-3 days in the presence of 10 µg/mL puromycin and 500 µg/mL hygromycin until cell viability was >90% (Vi-CELL BLU, Beckman Coulter). Stable pools were seeded in production media at 2e6 viable cells per mL of culture and incubated at 36° C. in 5% $CO_2$ for 6 days. Cell supernatant was harvested by centrifugation and antibodies were purified by magnetic bead affinity chromatography using AmMag™ Protein A Magnetic Beads (GenScript) or MAG SEPHAROSE™ PrismA (Cytiva). The identity of each variant was confirmed by intact mass spectrometry. For each variant, the expression titer in conditioned medium was measured by ForteBio OCTET® (Pall Life Sciences) using Protein A sensors. The percent of high molecular weight (% HMW) material present after Protein A affinity chromatography was measured by analytical size exclusion chromatography, and the % target protein purity was measured by non-reduced microcapillary electrophoresis (MCE NR) using a LabChip GXII (Perkin Elmer). Data for the variants prepared by this process appear in Table 10.

TABLE 10

Panel of rationally designed hotspot engineered TREM1 antibodies

| Antibody ID | Heavy chain SEQ ID NO. | Light chain SEQ ID NO. | % HMW material | % target purity |
|---|---|---|---|---|
| TREM1_30H2.001_huIgGz SEFL2 | 1883 | 2543 | 1 | 100 |
| TREM1_34D1.001_huIgGz SEFL2 | 1885 | 2544 | 3 | 99 |
| TREM1_3E12.001_huIgGz SEFL2 | 1887 | 2545 | 4 | 95 |
| TREM1_44A5.001_huIgGz SEFL2 | 1889 | 2546 | 1 | 100 |
| TREM1_46H7_huIgGz SEFL2 | 1891 | 2547 | 4 | 98 |
| TREM1_49A2.001_huIgGz SEFL2 | 1893 | 2548 | 3 | 97 |
| TREM1_50A12_huIgGz SEFL2 | 1895 | 2549 | 2 | 99 |
| TREM1_57C10.001_huIgGz SEFL2 | 1897 | 2550 | 1 | 99 |
| TREM1_57F5.001_huIgGz SEFL2 | 1899 | 2551 | 1 | 100 |
| TREM1_61B12.001_huIgGz SEFL2 | 1901 | 2552 | 2 | 99 |
| TREM1_61G5.001_huIgGz SEFL2 | 1903 | 2553 | 1 | 100 |

TABLE 10-continued

| | | | | |
|---|---|---|---|---|
| | | Panel of rationally designed hotspot engineered TREM1 antibodies | | |
| Antibody ID | Heavy chain SEQ ID NO. | Light chain SEQ ID NO: | % HMW material | % target purity |
| TREM1_63F8.001_huIgGz SEFL2 | 1905 | 2554 | 1 | 99 |
| TREM1_64D7.001_huIgGz SEFL2 | 1907 | 2555 | 0 | 99 |
| TREM1_66B8_huIgGz SEFL2 | 1909 | 2556 | 1 | 99 |
| TREM1_34D1.001_huIgGz SEFL2 | 1911 | 2557 | 3 | 99 |
| TREM1_44A5.001_huIgGz SEFL2 | 1913 | 2558 | 3 | 98 |
| TREM1_50A12_huIgGz SEFL2 | 1915 | 2559 | 0 | 98 |
| TREM1_57C10.001_huIgGz SEFL2 | 1917 | 2560 | ND | ND |
| TREM1_61G5.001_huIgGz SEFL2 | 1919 | 2561 | 9 | 97 |
| TREM1_64D7.001_huIgGz SEFL2 | 1921 | 2562 | 0 | 100 |
| TREM1_66B8_huIgGz SEFL2 | 1923 | 2563 | ND | ND |
| TREM1_57C10(VH:N83D_N87S, VL:S77R_C83S_F105Y_E148K) | 1925 | 2564 | ND | ND |
| TREM1_57C10(VH:N83D, VL:S77R_C83S_F105Y_E148K) | 1927 | 2565 | ND | ND |
| TREM1_66B8(VH:S81T_W115Y, VL:F7S) | 1929 | 2566 | 2 | 99 |
| TREM1_66B8(VH:S81T_W115H, VL:F7S) | 1931 | 2567 | 0 | 93 |
| TREM1_66B8(VH:S81T_W115F, VL:F7S) | 1933 | 2568 | 1 | 97 |
| TREM1_66B8(VH:S81T, VL:F7S_Q48P) | 1935 | 2569 | ND | ND |
| TREM1_66B8(VH:S81T, VL:F7S) | 1937 | 2570 | ND | ND |
| TREM1_19337(VH:N83D, VL:E15V_Y89F) | 1939 | 2571 | 1 | 100 |
| TREM1_19337(VH:N83D, VL:E15V_E46Q) | 1941 | 2572 | 1 | 98 |
| TREM1_19337(VH:N83D, VL:E15V) | 1943 | 2573 | 1 | 99 |
| TREM1_61G5(VH:N83D_W116Y, VL:Q55L_I101F) | 1945 | 2574 | 1 | 97 |
| TREM1_61G5(VH:N83D_W116Y, VL:Q55L) | 1947 | 2575 | 2 | 98 |
| TREM1_61G5(VH:N83D_W116F, VL:Q55L_I101F) | 1949 | 2576 | 2 | 97 |
| TREM1_61G5(VH:N83D_W116F, VL:Q55L) | 1951 | 2577 | ND | ND |
| TREM1_61G5(VH:N83D_I86T_W116Y, VL:Q55L_I101F) | 1953 | 2578 | 1 | 98 |
| TREM1_61G5(VH:N83D_I86T, VL:Q55L_I101F) | 1955 | 2579 | 1 | 100 |
| TREM1_61G5(VH:N83D, VL:Q55L_I101F) | 1957 | 2580 | 2 | 99 |
| TREM1_61G5(VH:N83D, VL:Q55L) | 1959 | 2581 | 2 | 99 |
| TREM1_50A12(VH:F90Y_S135V), | 1961 | 2582 | 0 | 98 |
| TREM1_50A12(VH:F90Y_S135A), | 1963 | 2583 | 0 | 84 |
| TREM1_50A12(VH:F90Y_D112E), | 1965 | 2584 | 0 | 99 |
| TREM1_24B1(VH:T48P_N83D, VL:N20T_N53K_A88D_I101F) | 1967 | 2585 | 0 | 97 |
| TREM1_24B1(VH:S68A_N83D, VL:N20T) | 1969 | 2586 | 0 | 99 |
| TREM1_24B1(VH:S65A_S68A_N83D, VL:N20T_N53K_A88D_I101F) | 1971 | 2587 | 1 | 97 |
| TREM1_24B1(VH:S65A_N83D, VL:N20T) | 1973 | 2588 | 0 | 100 |
| TREM1_24B1(VH:N83D_W134Y, VL:N20T_N53K_A88D_I101F) | 1975 | 2589 | 0 | 99 |
| TREM1_24B1(VH:N83D_W134H, VL:N20T_N53K_A88D_I101F) | 1977 | 2590 | 1 | 98 |
| TREM1_24B1(VH:N83D_W134F, VL:N20T_N53K_A88D_I101F) | 1979 | 2591 | 0 | 97 |
| TREM1_24B1(VH:N83D, VL:N20T_N53K_A88D_F91L_I101F) | 1981 | 2592 | 0 | 97 |
| TREM1_24B1(VH:N67Q_N83D, VL:N20T) | 1983 | 2593 | 0 | 93 |
| TREM1_24B1(VH:N61Q_N83D, VL:N20T) | 1985 | 2594 | 0 | 98 |
| TREM1_24B1(VH:N61Q_N67Q_N83D, VL:N20T_N53K_A88D_I101F) | 1987 | 2595 | 1 | 98 |
| TREM1_3E12(VH:W77R_T97R, VL:N40Q_C42S_L46Q_I53V_I90T) | 1989 | 2596 | ND | ND |
| TREM1_3E12(VH:W77R_T97R, VL:N40Q_C42S_I53V_I90T) | 1991 | 2597 | ND | ND |
| TREM1_3E12(VH:W77R_T97R, VL:C42G_L46Q_I53V_I90T) | 1993 | 2598 | ND | ND |
| TREM1_3E12(VH:W77R_T97R, VL:C42A_L46Q_I53V_I90T) | 1995 | 2599 | ND | ND |
| TREM1_3E12(VH:W77R, VL:N40Q_C42S_I53V_I90T) | 1997 | 2600 | ND | ND |
| TREM1_44A5(VLI10T_V74I_G81S_S98P_ C109F_D146E_L147I) | 1999 | 2601 | 4 | 99 |
| TREM1_44A5(VLI10T_V74I_G81S_C108F_ W111Y_D146E_L147I) | 2001 | 2602 | 3 | 99 |

TABLE 10-continued

Panel of rationally designed hotspot engineered TREM1 antibodies

| Antibody ID | Heavy chain SEQ ID NO. | Light chain SEQ ID NO: | % HMW material | % target purity |
|---|---|---|---|---|
| TREM1_44A5(VLI10T_V74I_G81S_C108F_ W111F_D146E_L147I) | 2003 | 2603 | 2 | 99 |
| TREM1_44A5(VLI10T_V74I_G81S_C108F_ W111H_D146E_L147I) | 2005 | 2604 | 3 | 99 |
| TREM1_44A5(VLI10T_V74I_G81S_S98P_ C108F_W111Y_D146E_L147I) | 2007 | 2605 | 5 | 98 |

A subset of three anti-TREM-1 lead antibodies from the XENOMOUSE® campaign (301H2 (19330), 49A2 (19333), and 461H7 (19332)) were also engineered through yeast display for improved manufacturability with retained binding to TREM-1. For each antibody, libraries were generated in which every possible adjacent pair of residues in all six GDRs were simultaneously mutated to all possible amino acids through use of degenerate NNK codons. The libraries were displayed on the surface of yeast derivative of BJ5464, wherein the Fd domain was fused to the N-terminus of alpha-agglutin and the LG was not fused to the yeast surface. Efficiency of display was measured by binding of ALEXA FLUOR®647 conjugated anti-Fab antibody. Libraries were sorted using fluorescence activated cell sorting (FACS) for high binding to biotin conjugated recombinant TREM-1 EGD) using streptavidin PE as fluorescence secondary. The variable domains present in the sorted binding/display double positive pools and display positive pools were amplified with primers specific to the framework 1 (FW1) and FW4 domains of the HG and LG and submitted to NGS analysis on an Illumina MiSeq for a 2×300 bp run. Mutations were selected after processing the data through a common frequency analysis where the ratio of positive binding amino acid frequencies are divided by positive display amino acid frequencies which is then normalized to the parental sequence ratio. The sequences for which the enrichment values were greater than or equal to the parental sequence were considered beneficial or tolerated diversity and were used for additional rational antibody engineering post affinity maturation.

Top display engineered variable domains were converted to the IgG1z SEFL2 isotype and cloned using Golden Gate cloning to assemble 1) synthetic DNA fragments comprising the antibody variable domains, 2) previously cloned "parts vectors" containing the necessary constant domains (i.e., CK or CL, CH1-CH2-CH3(118-447) (R292C, N297G, V302C)), and 3) a mammalian expression vector backbone. Heavy chains (HCs) were assembled into a vector backbone with a puromycin selection cassette and light chains (LCs) were assembled into a vector backbone with a hygromycin selection cassette. The HC and LC expression vectors were co-transfected in a 1:1 ratio in CHO-K1 cells using Lipofectamine LTX (Gibco) and stable pools were generated by passaging every 2-3 days in the presence of 10 μg/mL puromycin and 500 μg/mL hygromycin until cell viability was >90% (Vi-CELL BLU, Beckman Coulter). Stable pools were seeded in production media at 2e6 viable cells per mL of culture and incubated at 36° C. in 5% $CO_2$ for 6 days. Antibodies were purified by magnetic bead affinity chromatography using AMMAG™ Protein A Magnetic Beads (GenScript). The identity of each molecule was confirmed by intact mass spectrometry. The percent of high molecular weight (% HMW) material present after Protein A affinity chromatography was measured by analytical size exclusion chromatography, and the % target protein purity was measured by non-reduced microcapillary electrophoresis (MCE NR) using a LabChip GXII (Perkin Elmer). Data for the variants prepared by yeast display hot-spot engineering appear in Table 11.

TABLE 11

Yeast display hot-spot engineered variant TREM1 antibodies

| Antibody ID | HC SEQ ID NO. | LC SEQ ID NO. | % HMW | % target purity |
|---|---|---|---|---|
| TREM1_30H2(VH:E17G_T24A,VL:S39A_L141Q_Q144K) | 2011 | 2233 | 21 | 99 |
| TREM1_30H2(VH:E17G_T24A,VL:S39I_L141Q_Q144K) | 2013 | 2235 | 22 | 85 |
| TREM1_30H2(VH:E17G_T24A,VL:S39H_L141Q_Q144K) | 2015 | 2237 | 21 | 99 |
| TREM1_30H2(VH:E17G_T24A,VL:S39V_L141Q_Q144K) | 2017 | 2239 | 20 | 87 |
| TREM1_30H2(VH:E17G_T24A, VL:M111I_L141Q_Q144K) | 2019 | 2241 | 38 | 99 |
| TREM1_30H2(VH:E17G_T24A, VL:M111L_L141Q_Q144K) | 2021 | 2243 | 29 | 99 |
| TREM1_30H2(VH:E17G_T24A,VL:W111F_L141Q_Q144K) | 2026 | 2245 | 15 | 99 |
| TREM1_30H2(VH:E17G_T24A,VL:W137Y_L141Q_Q144K) | 2025 | 2247 | 17 | 99 |
| TREM1_30H2(VH:E17G_T24A,VL:W137H_L141Q_Q144K) | 2027 | 2249 | 17 | 99 |
| TREM1_30H2(VH:E17G_T24A, VL:W137N_L141Q_Q144K) | 2029 | 2251 | 17 | 99 |
| TREM1_30H2(VH:V4L_E17G_T24A_A99E,VL:L141Q_Q144K) | 2031 | 2253 | 3 | 99 |
| TREM1_30H2(VH:V4L_E17G_T24A_A99E,VL:S39A_M111L_ L141Q_Q144K) | 2033 | 2255 | 15 | 95 |
| TREM1_30H2(VH:V4L_E17G_T24A_A99E,VL:S39A_M111L_ W137H_L141Q_Q144K) | 2035 | 2257 | 3 | 98 |
| TREM1_30H2(VH:V4L_E17G_T24A_A99E,VL:S39A_M111L_ W137N_L141Q_Q144K) | 2037 | 2259 | 3 | 97 |

TABLE 11-continued

| Yeast display hot-spot engineered variant TREM1 antibodies | | | | |
| --- | --- | --- | --- | --- |
| Antibody ID | HC SEQ ID NO. | LC SEQ ID NO. | % HMW | % target purity |
| TREM1_30H2(VH:V4L_E17G_T24A_A99E,VL:S39A_M110L_W111F_L141Q_Q144K) | 2039 | 2261 | 3 | 97 |
| TREM1_30H2(VH:V4L_E17G_T24A_A99E,VL:S39A_M110L_W111F_W137N_L141Q_Q144K) | 2041 | 2263 | 2 | 96 |
| TREM1_30H2(VH:V4L_E17G_T24A_A99E,VL:S39A_M110L_W111F_W137H_L141Q_Q144K) | 2043 | 2265 | 3 | 98 |
| TREM1_30H2(VH:V4L_E17G_T24A_A99E,VL:S39H_M111L_L141Q_Q144K) | 2045 | 2267 | 12 | 99 |
| TREM1_30H2(VH:V4L_E17G_T24A_A99E,VL:S39H_M111L_W137N_L141Q_Q144K) | 2047 | 2269 | 3 | 98 |
| TREM1_30H2(VH:V4L_E17G_T24A_A99E,VL:S39H_M111L_W137H_L141Q_Q144K) | 2049 | 2271 | 2 | 98 |
| TREM1_30H2(VH:V4L_E17G_T24A_A99E,VL:S39H_M110L_W111F_L141Q_Q144K) | 2051 | 2273 | 3 | 98 |
| TREM1_30H2(VH:V4L_E17G_T24A_A99E,VL:S39H_M110L_W111F_W137N_L141Q_Q144K) | 2053 | 2275 | 3 | 98 |
| TREM1_30H2(VH:V4L_E17G_T24A_A99E,VL:S39H_M110L_W111F_W137H_L141Q_Q144K) | 2055 | 2277 | 4 | 98 |
| TREM1_46H7(VL:R50Q) | 2057 | 2279 | 4 | 99 |
| TREM1_46H7(VL:S39A_R50Q) | 2059 | 2281 | 4 | 99 |
| TREM1_46H7(VL:S39I_R50Q) | 2061 | 2283 | 4 | 98 |
| TREM1_46H7(VL:S39H_R50Q) | 2063 | 2285 | 3 | 99 |
| TREM1_46H7(VL:S39V_R50Q) | 2065 | 2287 | 4 | 99 |
| TREM1_46H7(VL:R50Q_W111F) | 2067 | 2289 | 4 | 99 |
| TREM1_46H7(VL:R50Q_W137Y) | 2069 | 2291 | 4 | 99 |
| TREM1_46H7(VL:R50Q_W137H) | 2071 | 2293 | 5 | 99 |
| TREM1_46H7(VL:R50Q_W137N) | 2073 | 2295 | 9 | 99 |
| TREM1_46H7(VH:M12L, VL:R50Q) | 2075 | 2297 | 4 | 99 |
| TREM1_46H7(VH:M12L, VL:S39A_R50Q) | 2077 | 2299 | 3 | 99 |
| TREM1_46H7(VH:M12L,VL:S39A_R50Q_W111F) | 2079 | 2301 | 4 | 99 |
| TREM1_46H7(VH:M12L, VL:S39A_R50Q_W137Y) | 2081 | 2303 | 0 | 0 |
| TREM1_46H7(VH:M12L, VL:S39A_R50Q_W137H) | 2083 | 2305 | 4 | 99 |
| TREM1_46H7(VH:M12L,VL:S39A_R50Q_W111F_W137Y) | 2085 | 2307 | 4 | 99 |
| TREM1_46H7(VH:M12L, VL:S39A_R50Q_W111F_W137H) | 2087 | 2309 | 4 | 99 |
| TREM1_46H7(VH:M12L, VL:S39H_R50Q) | 2089 | 2311 | 3 | 99 |
| TREM1_46H7(VH:M12L, VL:S39H_R50Q_W111F) | 2091 | 2313 | 3 | 99 |
| TREM1_46H7(VH:M12L, VL:S39H_R50Q_W137N) | 2093 | 2315 | 9 | 99 |
| TREM1_46H7(VH:M12L, VL:S39H_R50Q_W137Y) | 2095 | 2317 | 3 | 99 |
| TREM1_46H7(VH:M12L, VL:S39H_R50Q_W111F_W137N) | 2097 | 2319 | 6 | 99 |
| TREM1_46H7(VH:M12L,VL:S39H_R50Q_W111F_W137Y) | 2099 | 2321 | 3 | 99 |
| TREM1_49A2(VH:M55V_A143T,VL:V78F_L139F) | 2101 | 2323 | 16 | 99 |
| TREM1_49A2(VH:M55V_A143T,VL:S48P_V78F_L139F) | 2103 | 2325 | 16 | 99 |
| TREM1_49A2(VH:M55V_A143T,VL:V78F_F91L_L139F) | 2105 | 2327 | 14 | 99 |
| TREM1_49A2(VH:M55V_M58I_A143T,VL:V78F_L139F) | 2107 | 2329 | 21 | 98 |
| TREM1_49A2(VH:M55V_A143T,VL:V78F_W135F_L139F) | 2109 | 2331 | 21 | 99 |
| TREM1_49A2(VH:M55V_D61H_A143T,VL:V78F_L139F) | 2111 | 2333 | 4 | 99 |
| TREM1_49A2(VH:M55V_G65A_A143T,VL:V78F_L139F) | 2113 | 2335 | 10 | 99 |
| TREM1_49A2(VH:M55V_G65L_A143T,VL:V78F_L139F) | 2115 | 2337 | 6 | 99 |
| TREM1_49A2(VH:M55V_D72E_A143T,VL:V78F_L139F) | 2117 | 2339 | 15 | 99 |
| TREM1_49A2(VH:M55V_M58I_G65A_S73A_A143T,VL:V78F_F91L_W135F_L139F) | 2119 | 2341 | 16 | 99 |
| TREM1_49A2(VH:M55V_S73A_A143T,VL:V78F_L139F) | 2121 | 2343 | 22 | 98 |
| TREM1_49A2(VH:M55V_M58I_G65A_S73A_A143T,VL:S48P_V78F_F91L_L139F) | 2123 | 2345 | 16 | 99 |
| TREM1_49A2(VH:M55V_M58I_G65A_S73A_A143T,VL:V78F_F91L_L139F) | 2125 | 2347 | 22 | 99 |
| TREM1_49A2(VH:M55V_M58I_G65A_D72E_A143T,VL:S48P_V78F_F91L_L139F) | 2127 | 2349 | 15 | 99 |
| TREM1_49A2(VH:M55V_M58I_G65A_D72E_A143T,VL:V78F_F91L_L139F) | 2129 | 2351 | 16 | 99 |
| TREM1_49A2(VH:M55V_M58I_G65A_D72E_A143T,VL:S48P_V78F_F91L_W135F_L139F) | 2131 | 2353 | 21 | 99 |
| TREM1_49A2(VH:M55V_M58I_G65A_D72E_A143T,VL:V78F_F91L_W135F_L139F) | 2133 | 2355 | 21 | 98 |
| TREM1_49A2(VL:L139F) | 2135 | 2357 | 12 | 98 |

Comparison of bivalent and monovalent anti-TREM-1 mAbs in HEK293 cells expressing TREM-1/DAP12 was carried out by analysis of the phosphorylation levels of Syk kinase in cells using a p-Syk ALPHALISA® (Perkin-Elmer). Briefly, HEK293 cells stably expressing human TREM1 and DAP12 were cultured in DMEM/F12 Ham medium (Corning) supplemented with 10% dialyzed FBS (Gibco), 2 mM GlutaMAX (Gibco), 2 mM L-glutamine (Sigma), 1% penicillin/streptomycin (Gibco) and 0.1 mg/mL zeocin (Gibco) at 37° C./5% $CO_2$. One day prior to experiment, the cells were detached using Trypsin-EDTA and centrifuged at 400×g for 5 minutes. The cell pellet was resuspended in complete medium before a second centrifugation at 400×g for 5 minutes. After centrifugation the cells were resuspended in complete medium at a concentration of $1\times10^6$ cells/mL and seeded to CELLBIND® 96-well clear flat bottom polystyrene plates (Corning) at a final volume of 100 µL/well or 50,000 cells/well. The seeded plates were incubated at 37° C./5% $CO_2$ overnight for 18 to 24 hours. On the day of experiment, 70 µL of medium was removed from each well. TREM1 antibodies were diluted to 3 times the highest final concentration in a 4-fold serial dilution in assay medium (DMEM/F12 HAM medium supplemented with 10% heat inactivated FBS). The crosslinking reagent Protein G (Sigma) was prepared at 3 times the final concentration using assay medium. The titrated TREM1 antibodies were mixed 1 to 1 with either Protein G or assay medium and 60 µL of each TREM1 antibodies+/−crosslinking reagent was added to each well containing cells. These plates were incubated at room temperature for 1 hour before all medium was removed from the wells and the cells were then lysed using 25 µL/well of lysis buffer (M-Per Mammalian Protein Extraction Reagent and 1× Halt Protease/Phosphatases Inhibitor). The cells were incubated with lysis buffer on ice for 1 hour before 5 µL of cell lysate was transferred to each well of a 384-well white plate (PerkinElmer) containing AlphaLISA® acceptor cocktail (1 nM anti-pSyk, rabbit IgG (anti-phosphoSyk(Tyr525/526) (Clone C87C1)) (Cell Signaling Technology), 1 nM biotin-anti-Syk, mouse IgG (Clone 4D10) (BD Biosciences), 10 µg/mL anti-rabbit-IgG AlphaLISA® acceptor beads (PerkinElmer), and 1× Halt Inhibitor, in 1× AlphaLISA® Immunoassay Buffer (PerkinElmer)). The plates were further incubated on ice for 2 hours before 5 µL of AlphaLISA® donor cocktail (streptavidin-alpha-donor beads (PerkinElmer) in 1× Immunoassay Buffer) was added at 40 µg/mL final concentration and incubated at room temperature in the dark for 1 hour. After incubation, phospho-Syk (pSyk) signal was detected via FRET (fluorescence resonance energy transfer) using ENVISION® plate reader (PerkinElmer). Results were calculated by ratio of sample pSyk signal/basal pSyk signal with potency and max signal being compared between the variations of each antibody. Bivalent anti-TREM-1 mAbs treatment alone induces weak signals in TREM-1/DAP12-expressing cells. No pSyk signal was observed with monovalent anti-TREM-1 mAbs, and cross-linking bivalent and monovalent anti-TREM-1 mAbs with protein G result in pSyk induction.

Clading and Alignment of Antibody Sequences: The VH and VL domains of input antibody sequences were extracted and aligned to a structure-based IgG numbering system based on Honegger and Pluckthun (J Mol Biol. 309(3):657-70, 2001). A distance matrix was generated from the composite multiple sequence alignment using an uncorrected model, in which the distance between two sequences is the fraction of mismatches in both the VH and VL domains. Finally, the distance matrix was used to construct a tree via the UPGMA (unweighted pair group method with arithmetic mean) method (Sokal and Michener, University of Kansas Science Bulletin. 38: 1409-1438, 1958), and related sequences were grouped based on a branch traversal limit of 0.2. Alignments were refined manually based on chemical similarity of amino acids to generate consensus CDR sequences for each claded group resulting in the sequences shown in Table 12.

TABLE 12

| Consensus Sequences of TREM-1 Antigen Binding Proteins | | | | | | |
|---|---|---|---|---|---|---|
| Alignment Group | LCDR1 | LCDR2 | LCDR3 | HCDR1 | HCDR2 | HCDR3 |
| Group I | $X_1ASQSX_2X_3X_4NLA$ (SEQ ID NO: 2199) | $GAX_1X_2RAT$ (SEQ ID NO: 2200), | $QX_1X_2X_3X_4X_5X_6PX_7T$ (SEQ ID NO: 2201) | $X_1X_2X_3MX_4$ (SEQ ID NO: 2202) | $X_1X_2X_3X_4X_5X_6X_7X_8X_9YYX_{10}X_{11}X_{12}VKG$ (SEQ ID NO: 2205) | $X_1X_2X_3X_4X_5X_6X_7X_8X_9YYX_{10}$ (SEQ ID NO: 2203) |
| | RASQSVNSNLA (SEQ ID NO: 2212) QASQDIHLN (SEQ ID NO: 2215) | GASTRAT (SEQ ID NO: 2219); | QQFKNWPPT (SEQ ID NO: 2222); | AYAMS (SEQ ID NO: 2227) | TSGSGSTTYYADSVKG (SEQ ID NO: 2230) | VAGSNFLFDY (SEQ ID NO: 2670). |
| Group II | RASQGIRKWLA (SEQ ID NO: 2216) | AASRLQS (SEQ ID NO: 2221) | LQAHGFPWT (SEQ ID NO: 2224); QFWPPWT (SEQ ID NO: 2226) | SYWMS (SEQ ID NO: 2229) | NIKQDGSEEYYVDSVKG (SEQ ID NO: 2232); TSGSGTYYADSVKG (SEQ ID NO: 2669) | DYGDSFDY (SEQ ID NO: 2673) |
| Group III | $QASX_1DIX_2X_3X_4LN$ (SEQ ID NO: 2204 ) | $X_1X_2X_3X4LET$ (SEQ ID NO: 2206) | $QX_1YX_3X_4X_5PX_6T$ (SEQ ID NO: 2207) | $X_1YDIN$ (SEQ ID NO: 2208) | $X_1X_2NPX_3X_4GX_5X6GX_7X_8X_9X_{10}FX_{11}X_{12}$ (SEQ ID NO: 2209) | $X_1X_2X_3X_4X_5X_6X_7X_8X_9X_{10}X_{11}X_{12}FX_{13}X_{14}$ (SEQ ID NO: 2210) |

TABLE 12-continued

Consensus Sequences of TREM-1 Antigen Binding Proteins

| Alignment Group | LCDR1 | LCDR2 | LCDR3 | HCDR1 | HCDR2 | HCDR3 |
|---|---|---|---|---|---|---|
| | QASQDIRK HLN (SEQ ID NO: 2213); | DASNLET (SEQ ID NO: 2220); | QHYDNLPI T (SEQ ID NO: 2223); QQYDNLPL T (SEQ ID NO: 2225 | RYDIN (SEQ ID NO: 2228) | WMNPNSG NSSVQKFR G (SEQ ID NO: 2231) | GGYTSSW RWYFDL (SEQ ID NO: 2671); GGYTSSW SRWYFDL (SEQ ID NO: 2672) |

Example 4-Generation of IL-10 Mutein Antigen Binding Proteins

Generation and selection of bivalent and monovalent anti-TREM-1 mAb/IL-10 mutein therapeutic fusions, the PK/PD of the fusions, and effects on colitis model with murine bivalent and monovalent anti-TREM-1 mAb/IL-10mutein are evaluated.

IL-10 wild type, IL-10M1 or IL-10 muteins were fused to the C terminus of the anti-TREM-1 antibody Fc domain. For almost all fusions, the ultimate K residue is removed from the Fc region of the antibody (referred to as "desK"). In one example, the linker between the anti-TREM-1 antibody and the IL-10 variant is a GGGGS (G4S) (SEQ ID NO: 2725) and the internal IL-10 linker is GGGSGG (SEQ ID NO: 2676) (G3SG2).

Preparation of symmetric fusions of IL-10 muteins with anti-TREM-1 Ab fragments: Antibody-cytokine fusions were constructed by fusing IL-10M1 or engineered variants of IL-10M1 to the C-terminus of the heavy chain of an anti-TREM-1 IgG1z SEFL2 antibody after removing the ultimate Lys residue (K447−) and appending a 5 amino acid linker with the sequence G4S (SEQ ID NO: 2725) between the antibody and the cytokine. Antibody-cytokine recombinant expression constructs were produced using Golden Gate cloning to assemble 1) synthetic DNA fragments comprising the antibody variable domains, 2) synthetic DNA fragments comprising the linker plus designed cytokine, 3) previously cloned "parts vectors" containing the necessary constant domains (i.e., CK or CL, and CH1-CH2-CH3(118-446)(R292C, N297G, V302C)), and 4) a mammalian expression vector backbone. Fused heavy chains (HCs) were assembled into a vector backbone with a puromycin selection cassette and light chains (LCs) were assembled into a vector backbone with a hygromycin selection cassette. The fused HC and LC expression vectors were co-transfected in a 1:1 ratio in CHO-K1 cells using LIPO-FECTAMINE® LTX (Gibco) and stable pools were generated by passaging every 2-3 days in the presence of 10 µg/mL puromycin and 500 µg/mL hygromycin until cell viability was >90% (Vi-CELL BLU, Beckman Coulter). Stable pools were seeded in production media at 2e6 viable cells per mL of culture and incubated at 36° C. in 5% $CO_2$ for 6 days. Cell supernatant was harvested by centrifugation and antibodies were purified using an automated, 3-column, tandem chromatography process.

Preparation of asymmetric fusions of IL-10 muteins with anti-TREM-1 Ab fragments: Asymmetric Fab-HeteroFc-cytokine fusions (aka "monovalent" antibody-cytokine fusions) were made by fusing IL-10M1 or engineered variants of IL-10M1 to both the C-terminus of an antibody heavy chain and to the C-terminus of a huFc(221-446)

domain, both of which were further engineered to preferentially heterodimerize through electrostatic steering driven by oppositely charged mutations installed in the CH3 domain of each chain ("charge pair mutations"). Fab-HeteroFc-cytokine fusions are therefore three-chain proteins comprising 1) an antibody LC, 2) an antibody HC of the IgG1z SEFL2 isotype that has been further engineered with charge pair mutations E356K and D399K and to which IL-10M1 or a variant of IL-10M1 has been fused to the C-terminus after removing the ultimate Lys residue (K447−) and appending a 5 amino acid linker with the sequence Gly-Gly-Gly-Gly-Ser (SEQ ID NO: 2725) between the antibody and the cytokine, and 3) an huFc(221-446) domain of the IgG1z SEFL2 isotype further engineered with charge pair mutations K392D, K409D, and K434D (underlined in sequence below) and to which IL-10M1 or a variant of IL-10M1 has been fused to the C-terminus after removing the ultimate Lys residue (K447−) and appending a 5 amino acid linker with the sequence Gly-Gly-Gly-Gly-Ser (SEQ ID NO: 2725) (no underline, boldface) between the Fc and the cytokine (example IL-10 mutein, double underline):

DKTHTCPPCPAPELLGGPSVFLFPPKPKDTLMISRTPEVTCVVVDVSHE

DPEVKENWYVDGVEVHNAKTKPCEEQYGSTYRCVSVLIVLHQDWLNGKE

YKCKVSNKALPAPIEKTISKAKGQPREPQVYTLPPSREEMTKNQVSLTC

LVKGFYPSDIAVEWESNGQPENNYDTTPPVLDSDGSFFLYSDLTVDKSR

WQQGNVFSCSVMHEALHNHYTQDSLSLSPGGGGGSSPGQGTQSENSCTH

FPGNLPNMLRDLLDAFSRVKIFFQMKDQLDNLLLKESLLEDFKGYLGCQ

ALSEMIQFYLEEVMPQAENQDPDIKAHVNSLGENLKTLRLRLRRCHRFL

PCENGGGSGGKSKAVEQVKNAFNKLQEKGIYKAMSEFDIFINYIEAYMT

MKIRN.

Cell supernatant was harvested by centrifugation and antibody fusions were purified using an automated, 3-column, tandem chromatography process. Antibody fusions were affinity captured and immediately buffer exchanged by gel filtration using SEPHADEX® G25 resin (Cytiva), and further polished by size-exclusion using SUPERDEX®200 Increase resin (Cytiva). The identity of each variant was confirmed by intact mass spectrometry. For each variant, the expression titer in conditioned medium was measured by ForteBio OCTET® (Pall Life Sciences) using Protein A sensors. The percent of high molecular weight (% HMW) material present after size exclusion chromatography (SEC) was measured by analytical SEC, and the % target protein purity was measured by non-reduced microcapillary electrophoresis using a LABCHIP® GXII (Perkin Elmer).

Aggregation propensity and monomer stability were evaluated by stressing samples at 40° C. for 1 and 2 weeks. Stressed and $T_0$ samples were then analyzed by analytical SEC to quantify increases in aggregation (% HMW) and loss of monomer in $T_0$ vs. post stresses. The results for selected molecules are shown in Tables 13A and 13B. Bispecific functional activity was measured by inhibition of TNFα production in LPS-stimulated PBMCs.

TABLE 13A

| Characteristics of TREM-1-IL-10 Fusion Proteins | | | | |
|---|---|---|---|---|
| Clone | % HMW | % target purity | Heavy Chain SEQ ID NO: | Light Chain SEQ ID NO: |
| TREM1_30H2.001_G4S_huIL10[R27L] | 73 | 45 | 863 | 864 |
| TREM1_30H2.001_G4S_huIL10[K138L] | 90 | 88 | 865 | 866 |
| TREM1_30H2.001_G4S_huIL10[K138D] | 64 | 48 | 867 | 868 |
| TREM1_30H2.001_G4S_huIL10[D41G] | 96 | 82 | 869 | 870 |
| TREM1_30H2.001_G4S_huIL10[Q38R] | 96 | 88 | 871 | 872 |
| TREM1_30H2.001_G4S_huIL10[L46K] | 97 | 91 | 873 | 874 |
| TREM1_30H2.001_G4S_huIL10[K34D] | 69 | 92 | 875 | 876 |
| TREM1_30H2.001_G4S_huIL10[Q38E] | 94 | 90 | 877 | 878 |
| TREM1_44A5.001_G4S_huIL10[R27L] | 70 | 59 | 879 | 880 |
| TREM1_44A5.001_G4S_huIL10[K138L] | 0 | 90 | 881 | 882 |
| TREM1_44A5.001_G4S_huIL10[K138D] | 69 | 63 | 883 | 884 |
| TREM1_44A5.001_G4S_huIL10[D41G] | 97 | 88 | 885 | 886 |
| TREM1_44A5.001_G4S_huIL10[Q38R] | 98 | 94 | 887 | 888 |
| TREM1_44A5.001_G4S_huIL10[L46K] | 98 | 92 | 889 | 890 |
| TREM1_44A5.001_G4S_huIL10[K34D] | 65 | 91 | 891 | 892 |
| TREM1_44A5.001_G4S_huIL10[Q38E] | 94 | 93 | 893 | 894 |
| TREM1_46H7_G4S_huIL10[R27L] | 71 | 49 | 895 | 896 |
| TREM1_46H7_G4S_huIL10[K138L] | 86 | 89 | 897 | 898 |
| TREM1_46H7_G4S_huIL10[K138D] | 74 | 50 | 899 | 900 |
| TREM1_46H7_G4S_huIL10[D41G] | 96 | 86 | 901 | 902 |
| TREM1_46H7_G4S_huIL10[Q38R] | 97 | 94 | 903 | 904 |
| TREM1_46H7_G4S_huIL10[L46K] | 97 | 91 | 905 | 906 |
| TREM1_46H7_G4S_huIL10[K34D] | 64 | 91 | 907 | 908 |
| TREM1_46H7_G4S_huIL10[Q38E] | 93 | 92 | 909 | 910 |
| TREM1_49A2.001_G4S_huIL10[R27L] | 82 | 50 | 911 | 912 |
| TREM1_49A2.001_G4S_huIL10[K138L] | 91 | 90 | 913 | 914 |
| TREM1_49A2.001_G4S_huIL10[K138D] | 73 | 42 | 915 | 916 |
| TREM1_49A2.001_G4S_huIL10[D41G] | | | 917 | 918 |
| TREM1_49A2.001_G4S_huIL10[Q38R] | 99 | 96 | 919 | 920 |
| TREM1_49A2.001_G4S_huIL10[L46K] | 98 | 96 | 921 | 922 |
| TREM1_49A2.001_G4S_huIL10[K34D] | 78 | 87 | 923 | 924 |
| TREM1_49A2.001_G4S_huIL10[Q38E] | 97 | 93 | 925 | 926 |
| TREM1_50A12_G4S_huIL10[R27L] | 92 | 72 | 927 | 928 |
| TREM1_50A12_G4S_huIL10[K138L] | 90 | 86 | 929 | 930 |
| TREM1_50A12_G4S_huIL10[K138D] | | | 931 | 932 |
| TREM1_50A12_G4S_huIL10[D41G] | 96 | 73 | 933 | 934 |
| TREM1_50A12_G4S_huIL10[Q38R] | 97 | 73 | 935 | 936 |
| TREM1_50A12_G4S_huIL10[L46K] | 98 | 64 | 937 | 938 |
| TREM1_50A12_G4S_huIL10[K34D] | 82 | 89 | 939 | 940 |
| TREM1_50A12_G4S_huIL10[Q38E] | | | 941 | 942 |
| TREM1_57C10.001_G4S_huIL10[R27L] | 75 | 51 | 943 | 944 |
| TREM1_57C10.001_G4S_huIL10[K138L] | 88 | 93 | 945 | 946 |
| TREM1_57C10.001_G4S_huIL10[K138D] | 65 | 52 | 947 | 948 |
| TREM1_57C10.001_G4S_huIL10[D41G] | 96 | 86 | 949 | 950 |
| TREM1_57C10.001_G4S_huIL10[Q38R] | 97 | 95 | 951 | 952 |
| TREM1_57C10.001_G4S_huIL10[L46K] | 98 | 94 | 953 | 954 |
| TREM1_57C10_G4S_huIL1[K34D] | | | 955 | 956 |
| TREM1_57C10_G4S_huIL10[Q38E] | | | 957 | 958 |
| TREM1_61G5.001_G4S_huIL10[R27L] | 78 | 62 | 959 | 960 |
| TREM1_61G5.001_G4S_huIL10[K138L] | 88 | 93 | 961 | 962 |
| TREM1_61G5.001_G4S_huIL10[K138D] | 63 | 57 | 963 | 964 |
| TREM1_61G5.001_G4S_huIL10[D41G] | 95 | 87 | 965 | 966 |
| TREM1_61G5.001_G4S_huIL10[Q38R] | 96 | 97 | 967 | 968 |
| TREM1_61G5.001_G4S_huIL10[L46K] | 96 | 94 | 969 | 970 |
| TREM1_61G5.001_G4S_huIL10[K34D] | 72 | 96 | 971 | 972 |
| TREM1_61G5.001_G4S_huIL10[Q38E] | 92 | 93 | 973 | 974 |
| TREM1_63F8.001_G4S_huIL10[R27L] | 75 | 51 | 975 | 976 |
| TREM1_63F8.001_G4S_huIL10[K138L] | 89 | 90 | 977 | 978 |
| TREM1_63F8.001_G4S_huIL10[K138D] | 64 | 57 | 979 | 980 |
| TREM1_63F8.001_G4S_huIL10[D41G] | 96 | 85 | 981 | 982 |
| TREM1_63F8.001_G4S_huIL10[Q38R] | 97 | 95 | 983 | 984 |
| TREM1_63F8.001_G4S_huIL10[L46K] | 98 | 93 | 985 | 986 |
| TREM1_63F8.001_G4S_huIL10[K34D] | 70 | 85 | 987 | 988 |
| TREM1_63F8_G4S_huIL10[Q38E] | | | 989 | 990 |
| TREM1_64D7.001_G4S_huIL10[R27L] | 62 | 51 | 991 | 992 |
| TREM1_64D7.001_G4S_huIL10[K138L] | 93 | 94 | 993 | 994 |
| TREM1_64D7.001_G4S_huIL10[K138D] | 77 | 55 | 995 | 996 |
| TREM1_64D7.001_G4S_huIL10[D41G] | 98 | 91 | 997 | 998 |
| TREM1_64D7.001_G4S_huIL10[Q38R] | 99 | 98 | 999 | 1000 |

TABLE 13A-continued

Characteristics of TREM-1-IL-10 Fusion Proteins

| Clone | % HMW | % target purity | Heavy Chain SEQ ID NO: | Light Chain SEQ ID NO: |
|---|---|---|---|---|
| TREM1_64D7.001_G4S_huIL10[L46K] | 98 | 96 | 1001 | 1002 |
| TREM1_64D7.001_G4S_huIL10[K34D] | 81 | 91 | 1003 | 1004 |
| TREM1_64D7.001_G4S_huIL10[Q38E] | 96 | 95 | 1005 | 1006 |
| TREM1_66B8_G4S_huIL10[R27L] | 80 | 59 | 1007 | 1008 |
| TREM1_66B8_G4S_huIL10[K138L] | 91 | 91 | 1009 | 1010 |
| TREM1_66B8_G4S_huIL10[K138D] | 70 | 63 | 1011 | 1012 |
| TREM1_66B8_G4S_huIL10[D41G] | 98 | 89 | 1013 | 1014 |
| TREM1_66B8_G4S_huIL10[Q38R] | 98 | 96 | 1015 | 1016 |
| TREM1_66B8_G4S_huIL10[L46K] | 99 | 95 | 1017 | 1018 |
| TREM1_66B8_G4S_huIL10[K34D] | 72 | 94 | 1019 | 1020 |
| TREM1_66B8_G4S_huIL10[Q38E] | 96 | 92 | 1021 | 1022 |
| TREM1_3E12.001_G4S_huIL10[R27L] | 66 | 68 | 1023 | 1024 |
| TREM1_3E12.001_G4S_huIL10[K138L] | 85 | 99 | 1025 | 1026 |
| TREM1_3E12.001_G4S_huIL10[K138D] | 57 | 68 | 1027 | 1028 |
| TREM1_3E12.001_G4S_huIL10[D41G] | 94 | 89 | 1029 | 1030 |
| TREM1_3E12_G4S_huIL10[Q38R] | | | 1031 | 1032 |
| TREM1_3E12.001_G4S_huIL10[L46K] | 97 | 98 | 1033 | 1034 |
| TREM1_3E12.001_G4S_huIL10[K34D] | 59 | 94 | 1035 | 1036 |
| TREM1_3E12.001_G4S_huIL10[Q38E] | 92 | 99 | 1037 | 1038 |
| TREM1_61B12_G4S_huIL10[R27L] | | | 1039 | 1040 |
| TREM1_61B12.001_G4S_huIL10[K138L] | 85 | 91 | 1041 | 1042 |
| TREM1_61B12.001_G4S_huIL10[K138D] | 58 | 53 | 1043 | 1044 |
| TREM1_61B12.001_G4S_huIL10[D41G] | 93 | 88 | 1045 | 1046 |
| TREM1_61B12.001_G4S_huIL10[Q38R] | 95 | 94 | 1047 | 1048 |
| TREM1_61B12.001_G4S_huIL10[L46K] | 97 | 92 | 1049 | 1050 |
| TREM1_61B12.001_G4S_huIL10[K34D] | 65 | 91 | 1051 | 1052 |
| TREM1_61B12.001_G4S_huIL10[Q38E] | 93 | 92 | 1053 | 1054 |
| TREM1_57F5.001_G4S_huIL10[R27L] | 75 | 48 | 1055 | 1056 |
| TREM1_57F5.001_G4S_huIL10[K138L] | 89 | 86 | 1057 | 1058 |
| TREM1_57F5.001_G4S_huIL10[K138D] | 67 | 50 | 1059 | 1060 |
| TREM1_57F5.001_G4S_huIL10[D41G] | 94 | 76 | 1061 | 1062 |
| TREM1_57F5.001_G4S_huIL10[Q38R] | 95 | 83 | 1063 | 1064 |
| TREM1_57F5.001_G4S_huIL10[L46K] | 95 | 80 | 1065 | 1066 |
| TREM1_57F5.001_G4S_huIL10[K34D] | 65 | 85 | 1067 | 1068 |
| TREM1_57F5.001_G4S_huIL10[Q38E] | 93 | 82 | 1069 | 1070 |
| TREM1_34D1.001_G4S_huIL10[R27L] | 86 | 60 | 1071 | 1072 |
| TREM1_34D1.001_G4S_huIL10[K138L] | 92 | 96 | 1073 | 1074 |
| TREM1_34D1.001_G4S_huIL10[K138D] | 78 | 49 | 1075 | 1076 |
| TREM1_34D1.001_G4S_huIL10[D41G] | 98 | 95 | 1077 | 1078 |
| TREM1_34D1.001_G4S_huIL10[Q38R] | 98 | 98 | 1079 | 1080 |
| TREM1_34D1.001_G4S_huIL10[L46K] | 98 | 98 | 1081 | 1082 |
| TREM1_34D1.001_G4S_huIL10[K34D] | 82 | 92 | 1083 | 1084 |
| TREM1_34D1.001_G4S_huIL10[Q38E] | 96 | 96 | 1085 | 1086 |

TABLE 13B

Characteristics of Selected Fusion Proteins with Fc sequences shown

| Clone | % HMW | % target purity | Heavy Chain SEQ ID NO: | Light Chain SEQ ID NO: | Fc region |
|---|---|---|---|---|---|
| TREM1_30H2.001_mono_G4S_huIL10[R27L] | 70 | 29 | 1087 | 1088 | 1089 |
| TREM1_30H2.001_mono_G4S_huIL10[K138L] | 97 | 80 | 1090 | 1091 | 1092 |
| TREM1_30H2.001_mono_G4S_huIL10[K138D] | 79 | 37 | 1093 | 1094 | 1095 |
| TREM1_30H2.001_mono_G4S_huIL10[D41G] | 96 | 81 | 1096 | 1097 | 1098 |
| TREM1_30H2.001_mono_G4S_huIL10[K34D] | 67 | 63 | 1105 | 1106 | 1107 |
| TREM1_30H2.001_mono_G4S_huIL10[Q38E] | 94 | 88 | 1108 | 1109 | 1110 |
| TREM1_44A5.001_mono_G4S_huIL10[R27L] | 88 | 29 | 1111 | 1112 | 1113 |
| TREM1_44A5.001_mono_G4S_huIL10[K138L] | 92 | 82 | 1114 | 1115 | 1116 |
| TREM1_44A5.001_mono_G4S_huIL10[K138D] | 85 | 36 | 1117 | 1118 | 1119 |
| TREM1_44A5.001_mono_G4S_huIL10[Q38R] | 96 | 89 | 1123 | 1124 | 1125 |
| TREM1_44A5.001_mono_G4S_huIL10[L46K] | 97 | 87 | 1126 | 1127 | 1128 |
| TREM1_44A5.001_mono_G4S_huIL10[K34D] | 71 | 69 | 1129 | 1130 | 1131 |
| TREM1_44A5.001_mono_G4S_huIL10[Q38E] | 95 | 88 | 1132 | 1133 | 1134 |
| TREM1_46H7_mono_G4S_huIL10[K138L] | 89 | 82 | 1138 | 1139 | 1140 |
| TREM1_46H7_mono_G4S_huIL10[K138D] | 78 | 33 | 1141 | 1142 | 1143 |
| TREM1_46H7_mono_G4S_huIL10[Q38R] | 97 | 92 | 1147 | 1148 | 1149 |
| TREM1_46H7_mono_G4S_huIL10[L46K] | 98 | 86 | 1150 | 1151 | 1152 |
| TREM1_46H7_mono_G4S_huIL10[K34D] | 66 | 65 | 1153 | 1154 | 1155 |

TABLE 13B-continued

| Clone | % HMW | % target purity | Heavy Chain SEQ ID NO: | Light Chain SEQ ID NO: | Fc region |
|---|---|---|---|---|---|
| TREM1_46H7_mono_G4S_huIL10[Q38E] | 94 | 88 | 1156 | 1157 | 1158 |
| TREM1_49A2.001_mono_G4S_huIL10[R27L] | 87 | 34 | 1159 | 1160 | 1161 |
| TREM1_49A2.001_mono_G4S_huIL10[K138L] | 90 | 82 | 1162 | 1163 | 1164 |
| TREM1_49A2.001_mono_G4S_huIL10[K138D] | 80 | 36 | 1165 | 1166 | 1167 |
| TREM1_49A2.001_mono_G4S_huIL10[D41G] | 94 | 81 | 1168 | 1169 | 1170 |
| TREM1_49A2.001_mono_G4S_huIL10[Q38R] | 97 | 90 | 1171 | 1172 | 1173 |
| TREM1_49A2.001_mono_G4S_huIL10[L46K] | 96 | 86 | 1174 | 1175 | 1176 |
| TREM1_49A2.001_mono_G4S_huIL10[K34D] | 63 | 66 | 1177 | 1178 | 1179 |
| TREM 1_49A2.001_mono_G4S_huIL10[Q38E] | 95 | 87 | 1180 | 1181 | 1182 |
| TREM1_50A12_mono_G4S_huIL10[R27L] | 92 | 30 | 1183 | 1184 | 1185 |
| TREM1_50A12_mono_G4S_huIL10[K138L] | 91 | 82 | 1186 | 1187 | 1188 |
| TREM1_50A12_mono_G4S_huIL10[K138D] | 86 | 24 | 1189 | 1190 | 1191 |
| TREM1_50A12_mono_G4S_huIL10[D41G] | 95 | 80 | 1192 | 1193 | 1194 |
| TREM1_50A12_mono_G4S_huIL10[Q38R] | 96 | 92 | 1195 | 1196 | 1197 |
| TREM1_50A12_mono_G4S_huIL10[L46K] | 96 | 89 | 1198 | 1199 | 1200 |
| TREM1_50A12_mono_G4S_huIL10[K34D] | 69 | 82 | 1201 | 1202 | 1203 |
| TREM1_50A12_mono_G4S_huIL10[Q38E] | 95 | 88 | 1204 | 1205 | 1206 |
| TREM1_57C10.001_mono_G4S_huIL10[R27L] | 81 | 19 | 1207 | 1208 | 1209 |
| TREM1_57C10.001_mono_G4S_huIL10[K138L] | 88 | 82 | 1210 | 1211 | 1212 |
| TREM1_57C10.001_mono_G4S_huIL10[K138D] | 77 | 31 | 1213 | 1214 | 1215 |
| TREM1_57C10.001_mono_G4S_huIL10[D41G] | 95 | 80 | 1216 | 1217 | 1218 |
| TREM1_57C10.001_mono_G4S_huIL10[Q38R] | 96 | 91 | 1219 | 1220 | 1221 |
| TREM1_57C10.001_mono_G4S_huIL10[L46K] | 97 | 87 | 1222 | 1223 | 1224 |
| TREM1_57C10.001_mono_G4S_huIL10[K34D] | 67 | 57 | 1225 | 1226 | 1227 |
| TREM1_57C10.001_mono_G4S_huIL10[Q38E] | 93 | 89 | 1228 | 1229 | 1230 |
| TREM1_61G5.001_mono_G4S_huIL10[R27L] | 93 | 87 | 1231 | 1232 | 1233 |
| TREM1_61G5.001_mono_G4S_huIL10[K138D] | 75 | 54 | 1237 | 1238 | 1239 |
| TREM1_61G5.001_mono_G4S_huIL10[D41G] | 93 | 88 | 1240 | 1241 | 1242 |
| TREM1_61G5.001_mono_G4S_huIL10[Q38R] | 92 | 87 | 1243 | 1244 | 1245 |
| TREM1_61G5.001_mono_G4S_huIL10[L46K] | 0 | 0 | 1246 | 1247 | 1248 |
| TREM1_61G5.001_mono_G4S_huIL10[Q38E] | 86 | 65 | 1252 | 1253 | 1254 |
| TREM1_63F8.001_mono_G4S_huIL10[R27L] | 79 | 34 | 1255 | 1256 | 1257 |
| TREM1_63F8.001_mono_G4S_huIL10[K138L] | 88 | 82 | 1258 | 1259 | 1260 |
| TREM1_63F8.001_mono_G4S_huIL10[K138D] | 76 | 34 | 1261 | 1262 | 1263 |
| TREM1_63F8.001_mono_G4S_huIL10[D41G] | 95 | 79 | 1264 | 1265 | 1266 |
| TREM1_63F8.001_mono_G4S_huIL10[Q38R] | 96 | 89 | 1267 | 1268 | 1269 |
| TREM1_63F8.001_mono_G4S_huIL10[L46K] | 97 | 86 | 1270 | 1271 | 1272 |
| TREM1_63F8.001_mono_G4S_huIL10[K34D] | 0 | 0 | 1273 | 1274 | 1275 |
| TREM1_63F8.001_mono_G4S_huIL10[Q38E] | 93 | 83 | 1276 | 1277 | 1278 |
| TREM1_64D7.001_mono_G4S_huIL10[R27L] | 83 | 29 | 1279 | 1280 | 1281 |
| TREM1_64D7.001_mono_G4S_huIL10[K138D] | 72 | 36 | 1285 | 1286 | 1287 |
| TREM1_64D7.001_mono_G4S_huIL10[D41G] | 97 | 82 | 1288 | 1289 | 1290 |
| TREM1_64D7.001_mono_G4S_huIL10[L46K] | 97 | 89 | 1294 | 1295 | 1296 |
| TREM1_64D7.001_mono_G4S_huIL10[K34D] | 0 | 0 | 1297 | 1298 | 1299 |
| TREM1_64D7.001_mono_G4S_huIL10[Q38E] | 0 | 0 | 1300 | 1301 | 1302 |
| TREM1_66B8_mono_G4S_huIL10[R27L] | 85 | 32 | 1303 | 1304 | 1305 |
| TREM1_66B8_mono_G4S_huIL10[K138D] | 0 | 0 | 1309 | 1310 | 1311 |
| TREM1_66B8_mono_G4S_huIL10[D41G] | 96 | 83 | 1312 | 1313 | 1314 |
| TREM1_66B8_mono_G4S_huIL10[Q38R] | 97 | 92 | 1315 | 1316 | 1317 |
| TREM1_66B8_mono_G4S_huIL10[L46K] | 97 | 91 | 1318 | 1319 | 1320 |
| TREM1_66B8_mono_G4S_huIL10[K34D] | 73 | 70 | 1321 | 1322 | 1323 |
| TREM1_66B8_mono_G4S_huIL10[Q38E] | 0 | 0 | 1324 | 1325 | 1326 |
| TREM1_3E12.001_mono_G4S_huIL10[K138D] | 77 | 32 | 1333 | 1334 | 1335 |
| TREM1_3E12.001_mono_G4S_huIL10[D41G] | 96 | 73 | 1336 | 1337 | 1338 |
| TREM1_3E12.001_mono_G4S_huIL10[L46K] | 97 | 82 | 1342 | 1343 | 1344 |
| TREM1_3E12.001_mono_G4S_huIL10[K34D] | 66 | 56 | 1345 | 1346 | 1347 |
| TREM1_3E12.001_mono_G4S_huIL10[Q38E] | 94 | 79 | 1348 | 1349 | 1350 |
| TREM1_61B12.001_mono_G4S_huIL10[R27L] | 78 | 33 | 1351 | 1352 | 1353 |
| TREM1_61B12.001_mono_G4S_huIL10[K138L] | 89 | 82 | 1354 | 1355 | 1356 |
| TREM1_61B12.001_mono_G4S_huIL10[K138D] | 81 | 34 | 1357 | 1358 | 1359 |
| TREM1_61B12.001_mono_G4S_huIL10[D41G] | 95 | 82 | 1360 | 1361 | 1362 |
| TREM1_61B12.001_mono_G4S_huIL10[Q38R] | 96 | 90 | 1363 | 1364 | 1365 |
| TREM1_61B12.001_mono_G4S_huIL10[L46K] | 97 | 88 | 1366 | 1367 | 1368 |
| TREM1_61B12.001_mono_G4S_huIL10[K34D] | 74 | 62 | 1369 | 1370 | 1371 |
| TREM1_61B12.001_mono_G4S_huIL10[Q38E] | 94 | 88 | 1372 | 1373 | 1374 |
| TREM1_57F5.001_mono_G4S_huIL10[R27L] | 79 | 36 | 1375 | 1376 | 1377 |
| TREM1_57F5.001_mono_G4S_huIL10[K138L] | 87 | 82 | 1378 | 1379 | 1380 |
| TREM1_57F5.001_mono_G4S_huIL10[K138D] | 80 | 33 | 1381 | 1382 | 1383 |
| TREM1_57F5.001_mono_G4S_huIL10[D41G] | 93 | 77 | 1384 | 1385 | 1386 |
| TREM 1_57F5.001_mono_G4S_huIL10[Q38R] | 95 | 88 | 1387 | 1388 | 1389 |
| TREM1_57F5.001_mono_G4S_huIL10[L46K] | 96 | 82 | 1390 | 1391 | 1392 |
| TREM1_57F5.001_mono_G4S_huIL10[K34D] | 74 | 67 | 1393 | 1394 | 1395 |

TABLE 13B-continued

| Clone | % HMW | % target purity | Heavy Chain SEQ ID NO: | Light Chain SEQ ID NO: | Fc region |
|---|---|---|---|---|---|
| | | | Characteristics of Selected Fusion Proteins with Fc sequences shown | | |
| TREM1_57F5.001_mono_G4S_huIL10[Q38E] | 93 | 86 | 1396 | 1397 | 1398 |
| TREM1_34D1.001_mono_G4S_huIL10[R27L] | 87 | 35 | 1399 | 1400 | 1401 |
| TREM1_34D1.001_mono_G4S_huIL10[K138L] | 92 | 82 | 1402 | 1403 | 1404 |
| TREM1_34D1.001_mono_G4S_huIL10[D41G] | 97 | 82 | 1408 | 1409 | 1410 |
| TREM1_34D1.001_mono_G4S_huIL10[Q38R] | 95 | 93 | 1411 | 1412 | 1413 |
| TREM1_34D1.001_mono_G4S_huIL10[L46K] | 97 | 88 | 1414 | 1415 | 1416 |
| TREM1_34D1.001_mono_G4S_huIL10[K34D] | 80 | 54 | 1417 | 1418 | 1419 |
| TREM1_34D1.001_mono_G4S_huIL10[Q38E] | 95 | 90 | 1420 | 1421 | 1422 |

The first, second, and third melting transition (Tm1, Tm2, Tm3, respectively) were measured by differential scanning calorimetry (DSC) using a MicroCal (Malvern) on a representative subset of molecules, as shown in Table 14.

TABLE 14

Melting Transitions of IL-10 Mutein-Anti-TREM-1 Antibody Fusion Proteins

| ANTI-TREM-1 MAB | IL-10 MUTATION | TM1 | TM2 | TM3 |
|---|---|---|---|---|
| 61B12 | L46K | 77.8 | 80.8 | 87.6 |
| 61B12 | Q38R | 78.2 | 80.6 | 87.1 |
| 61B12 | Q38E | 77.9 | 80.7 | 87.9 |

Proof-of-concept (PoC) antibody-cytokine molecules were generated as having either bivalent or monovalent cytokine fusions. C-terminal IL-10M1 or the mutein 038E was fused to the representative anti-TREM1 antibody 1B12. For all the versions of these PoC molecules, the terminal Lys at the C-terminus of the antibody was removed, and a sequence of Gly-Gly-Gly-Gly-Ser (SEQ ID NO: 2725) was added to link the cytokine to the antibody (as earlier stated). Additionally, for the versions of the PoC molecules with a monovalent cytokine, the Fc portion of the antibody was engineered with the same charge pair mutations mentioned previously. Monovalent cytokines were fused to either the positive (E356K and D399K) or negative (K392D, K409D, and K434D) arm of the antibody's heavy chain.

Fab antibody-cytokine and PoC antibody-cytokine recombinant expression constructs were produced using Golden Gate cloning to assemble 1) synthetic DNA fragments comprising the antibody variable domains, 2) synthetic DNA fragments comprising the linker plus designed cytokine, 3) previously cloned "parts vectors" containing the necessary constant domains (i.e., CK or CL, CH1-CH2-CH3 (118-446)(R292C, N297G, V302C, E356K, D399K), CH2-CH3(221-446)(R292C, N297G, V302C, K392D, K409D, K434D)), and 4) a mammalian expression vector backbone.

Fused HCs and fused Fc domains were assembled into a vector backbone with a puromycin selection cassette and LCs were assembled into a vector backbone with a hygromycin selection cassette. The fused HC, fused Fc, and LC expression vectors were co-transfected in a 1:1:1 ratio in CHO-K1 cells using LIPOFECTAMINE® LTX (Gibco) and stable pools were generated by passaging every 2-3 days in the presence of 10 µg/mL puromycin and 500 µg/mL hygromycin until cell viability was >90% (Vi-CELL BLU®, Beckman Coulter). Stable pools were seeded in production media at 2e6 viable cells per mL of culture and incubated at 36° C. in 5% $CO_2$ for 6 days.

Cell supernatant was harvested by centrifugation and antibody fusions were purified using an automated, 3-column, tandem chromatography process. Fab-HeteroFc-cytokine fusions were affinity captured using CAPTURESELECT™ CH1 XL (ThermoFisher), immediately buffer exchanged by gel filtration using SEPHADEX® G25 resin (Cytiva), and further polished by size-exclusion using SUPERDEX 200 Increase resin (Cytiva). The identity of each variant was confirmed by intact mass spectrometry. For each variant, the expression titer in conditioned medium was measured by ForteBio OCTET (Pall Life Sciences) using Protein A sensors. The percent of high molecular weight (% HMW) material present after Protein A affinity chromatography was measured by analytical size exclusion chromatography (SEC), and the % target protein purity was measured by non-reduced microcapillary electrophoresis using a LABCHIP GXII (Perkin Elmer). Aggregation propensity and monomer stability were evaluated by stressing samples at 40C for 1 and 2 weeks. Stressed and TO samples were then analyzed by analytical SEC to quantify increases in aggregation (% HMW) and loss of monomer post stress versus TO. Bispecific functional activity was measured by Inhibition of TNFα production in LPS-stimulated PBMCs and results for selected molecules are shown in Table 15.

TABLE 15

Functional assay data on selected bispecific cytokine fusions

| ID | Protein Type | LPS-stim PBMC assay EC50 (nM) n = 1 | LPS-stim PBMC assay EC50 (nM) n = 2 | LPS-stim PBMC assay EC50 (nM) n = 3 |
|---|---|---|---|---|
| 21324 | Fab-HeteroFc-cytokine fusion | N/A | N/A | N/A |
| 21330 | Fab-HeteroFc-cytokine fusion | 2 | 2 | 2 |
| 21338 | Fab-HeteroFc-cytokine fusion | 3 | N/A | 3 |
| 21369 | Fab-HeteroFc-cytokine fusion | 4 | 3 | 4 |

TABLE 15-continued

| | | Functional assay data on selected bispecific cytokine fusions | | |
|---|---|---|---|---|
| ID | Protein Type | LPS-stim PBMC assay EC50 (nM) n = 1 | LPS-stim PBMC assay EC50 (nM) n = 2 | LPS-stim PBMC assay EC50 (nM) n = 3 |
| 21351 | Fab-HeteroFc-cytokine fusion | 3 | N/A | N/A |
| 21358 | Fab-HeteroFc-cytokine fusion | 5 | N/A | N/A |
| 21365 | Fab-HeteroFc-cytokine fusion | N/A | 3 | 2 |
| 21374 | Fab-HeteroFc-cytokine fusion | N/A | N/A | 2 |
| 21381 | Fab-HeteroFc-cytokine fusion | 3 | 3 | 3 |
| 22437 | Fab-HeteroFc-cytokine fusion | N/A | 2 | 4 |
| 21387 | Fab-HeteroFc-cytokine fusion | 3 | N/A | 2 |
| 21392 | Fab-HeteroFc-cytokine fusion | 5 | 5 | N/A |
| 21404 | Fab-HeteroFc-cytokine fusion | 3 | 3 | 2 |
| 21225 | Antibody cytokine fusion | 4 | 3 | 3 |
| 21233 | Antibody cytokine fusion | 3 | 3 | N/A |
| 21241 | Antibody cytokine fusion | 2 | 2 | 3 |
| 21248 | Antibody cytokine fusion | N/A | 2 | N/A |
| 21255 | Antibody cytokine fusion | N/A | 2 | N/A |
| 21262 | Antibody cytokine fusion | N/A | 3 | N/A |
| 21268 | Antibody cytokine fusion | N/A | N/A | 2 |
| 21276 | Antibody cytokine fusion | 3 | N/A | 3 |
| 21283 | Antibody cytokine fusion | 4 | 3 | N/A |
| 21291 | Antibody cytokine fusion | 3 | 3 | 3 |
| 22424 | Antibody cytokine fusion | N/A | N/A | N/A |
| 21298 | Antibody cytokine fusion | 3 | 2 | 2 |
| 21306 | Antibody cytokine fusion | 5 | N/A | 5 |
| 21410 | Antibody cytokine fusion | 3 | 2 | 2 |

N/A-Not a proper dose curve,
1 = >0.001 to <0.01;
2 = >0.01 to <0.1;
3 = >0.1 to <1;
4 = >1 to <10,
5 = >10

Figure 2:
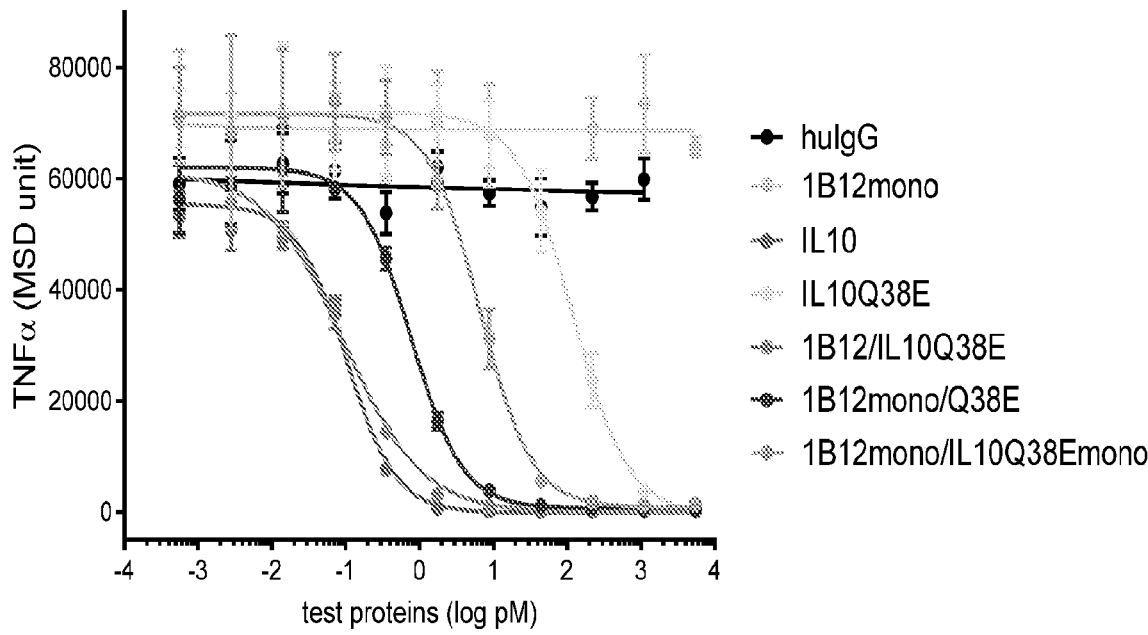
FIG. 2 shows that both bivalent and monovalent TREM-1 binding significantly enhanced IL-10 mutein suppression of monocyte activation.

Monovalent and bivalent antibodies prepared as described above and fused to IL-10 mutein Q38E were tested for monocyte activation. Briefly, monocytes were isolated from frozen PBMCs using Miltenyi Monocyte isolation kit II. Purified monocytes were plated in complete media at $10^5$ cells per well in 96 round well TC treated plate. Indicated test proteins were serial diluted 1:5 from 11000 pM to 0.005 pM. LPS was added to the cells at final concentration of 10 ng/mL. Plates were incubated overnight at 5.0% $CO_2$, 37° C. TNFα in cell supernatant was measured using the MSD Vplex human TNFα detection kits. FIG. 2 shows that bivalent anti-TREM-1 is more potent than monovalent anti-TREM-1, and bivalent IL-10 mutein is more potent than monovalent IL-10 mutein at the C-terminus.

Figure 3A:
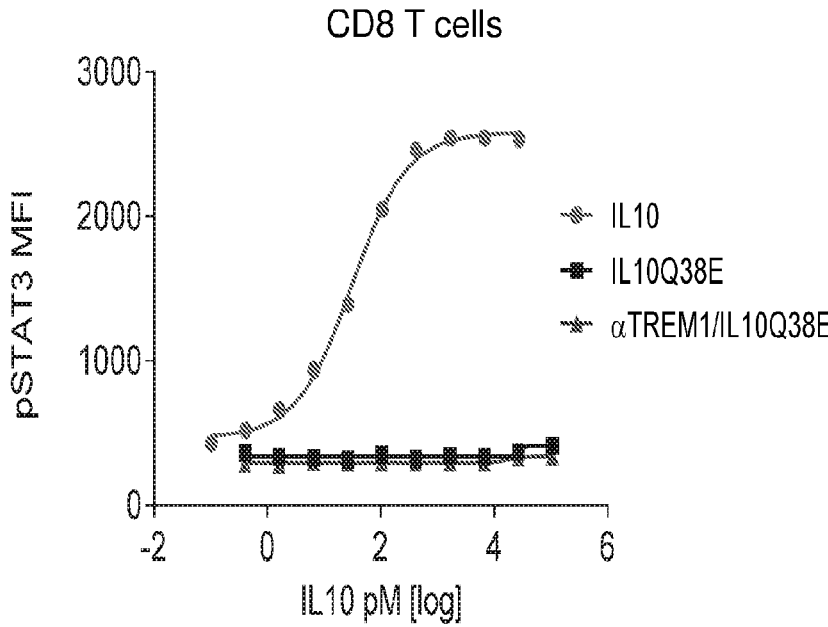
FIGS. 3A-3B illustrate that anti-TREM-1 mAb/IL-10mutein antigen binding proteins did not stimulate CD8+ T cell (FIG. 3A) and B cell (FIG. 3B) activation.
Figure 3B:
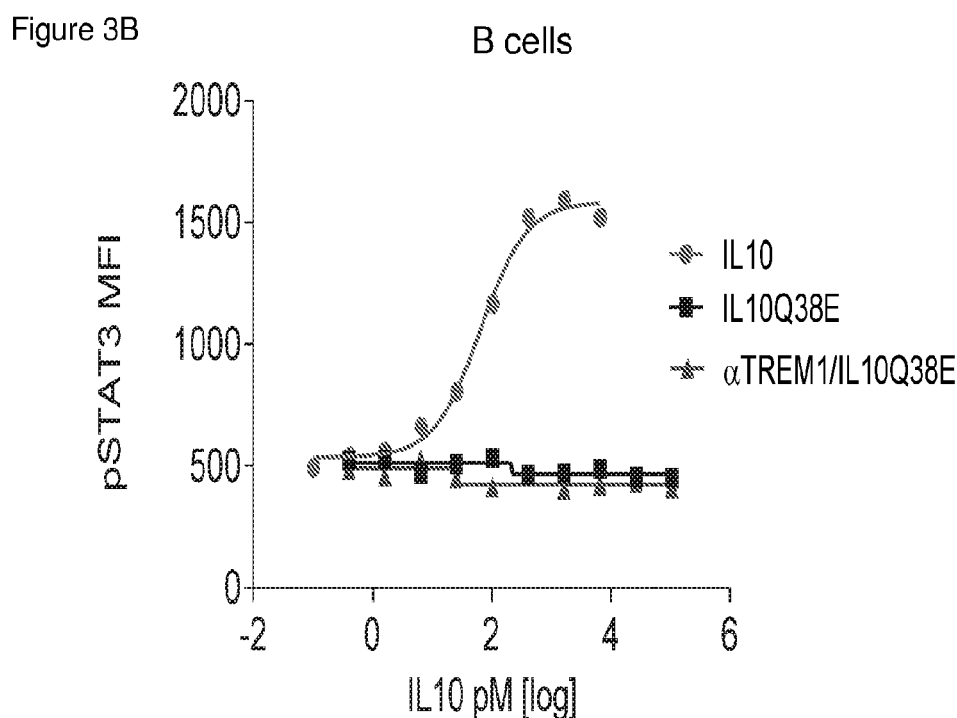
Figure 4A:
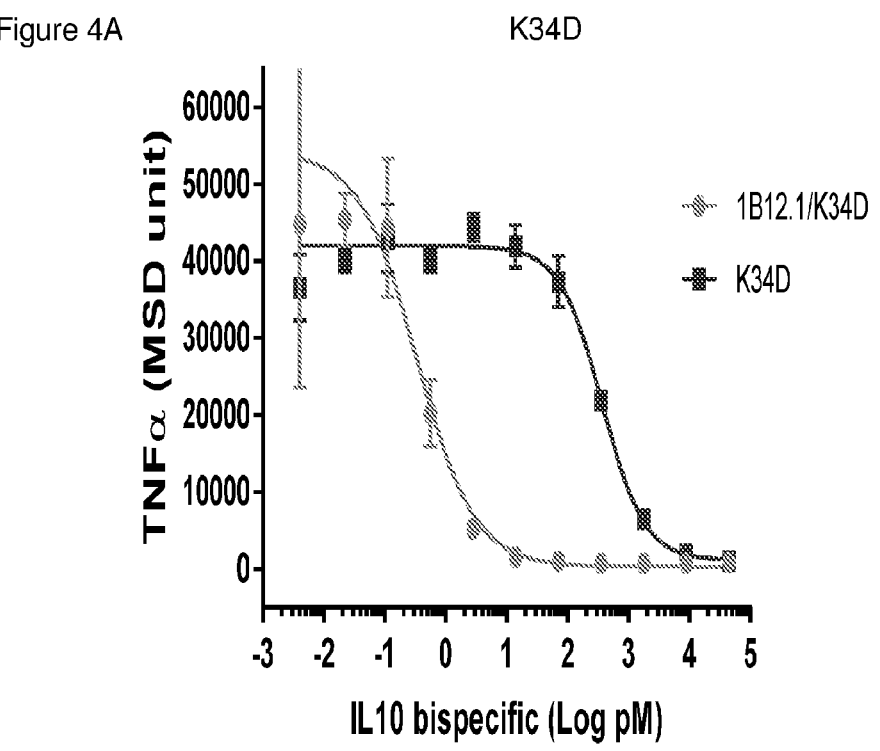
FIGS. 4A-4H illustrate that TREM-1 binding significantly enhanced IL-10 mutein suppression of monocyte activation for different fusion protein constructs.
Figure 4B:
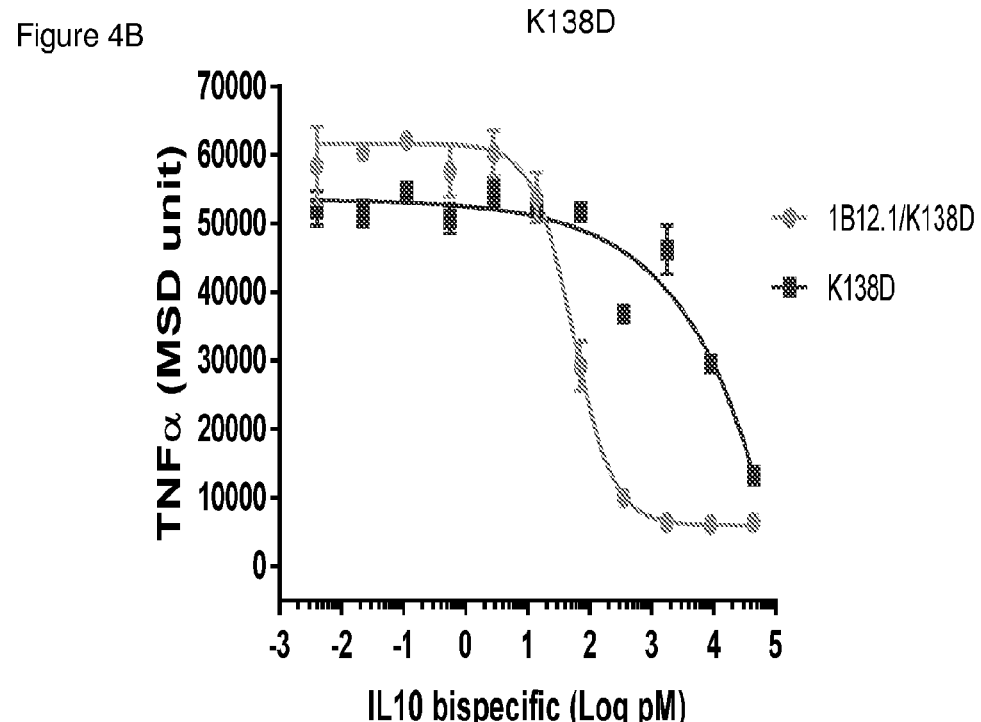
Figure 4C:
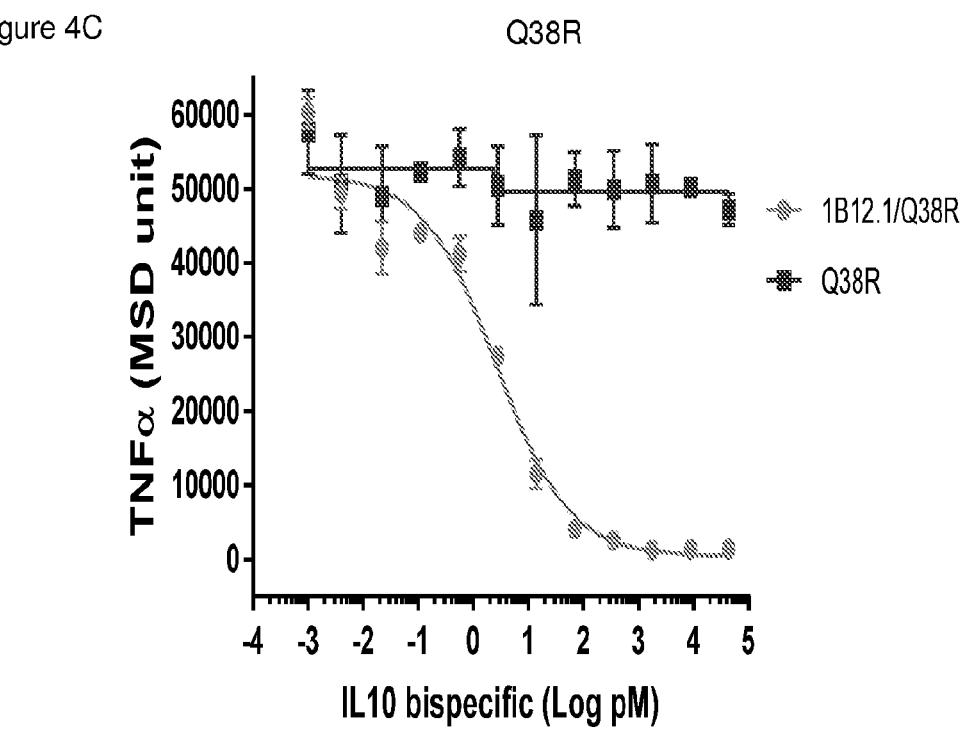
Figure 4D:
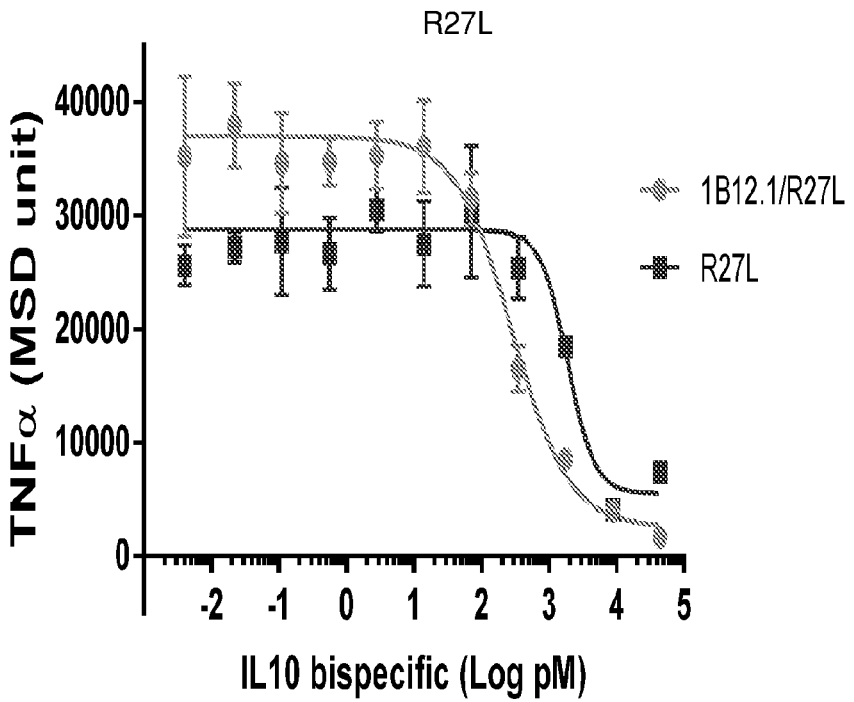
Figure 4E:
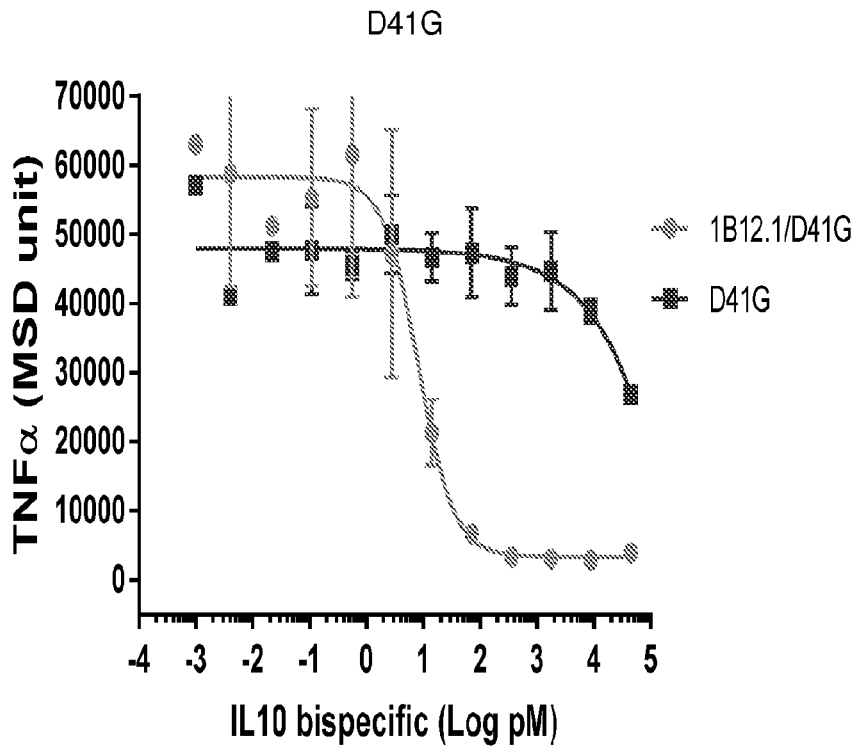
Figure 4F:
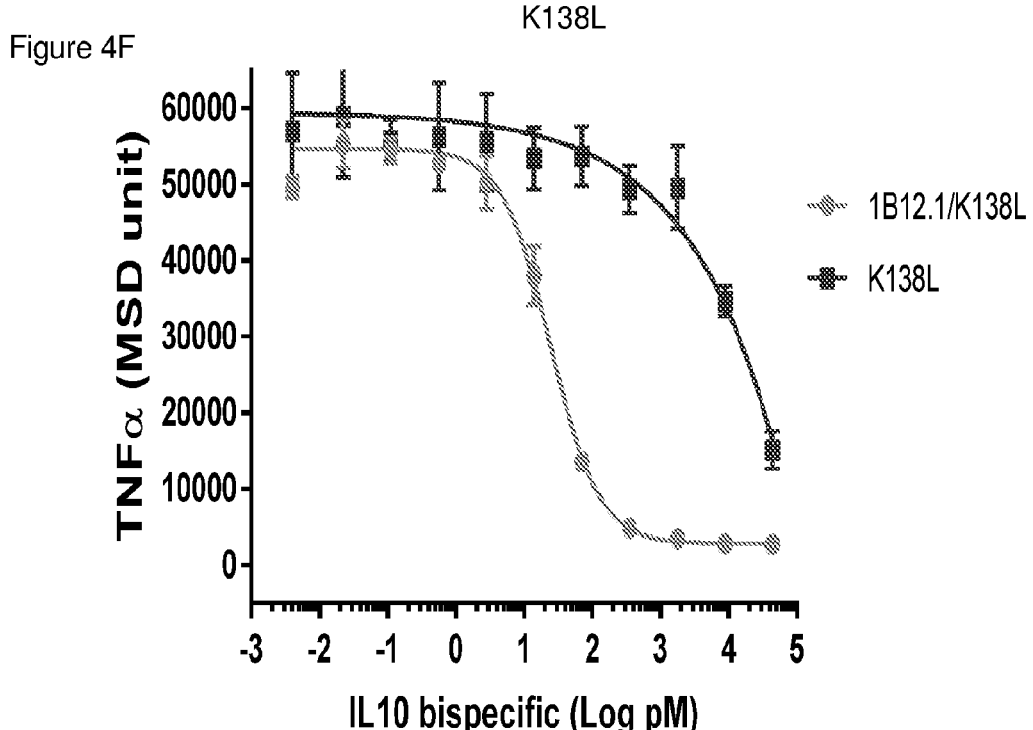
Figure 4G:
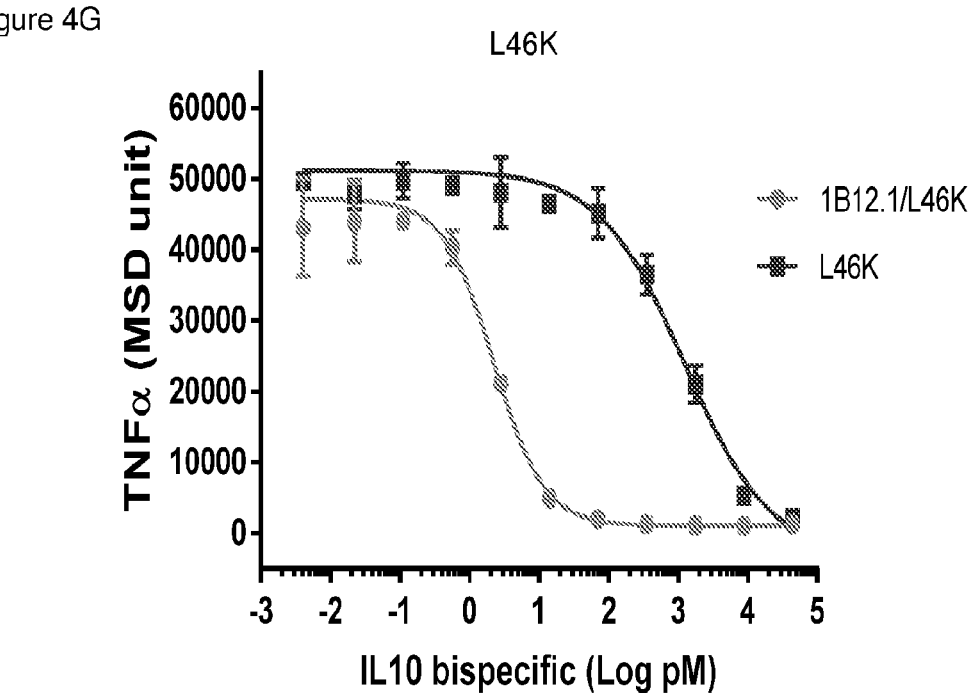
Figure 4H:
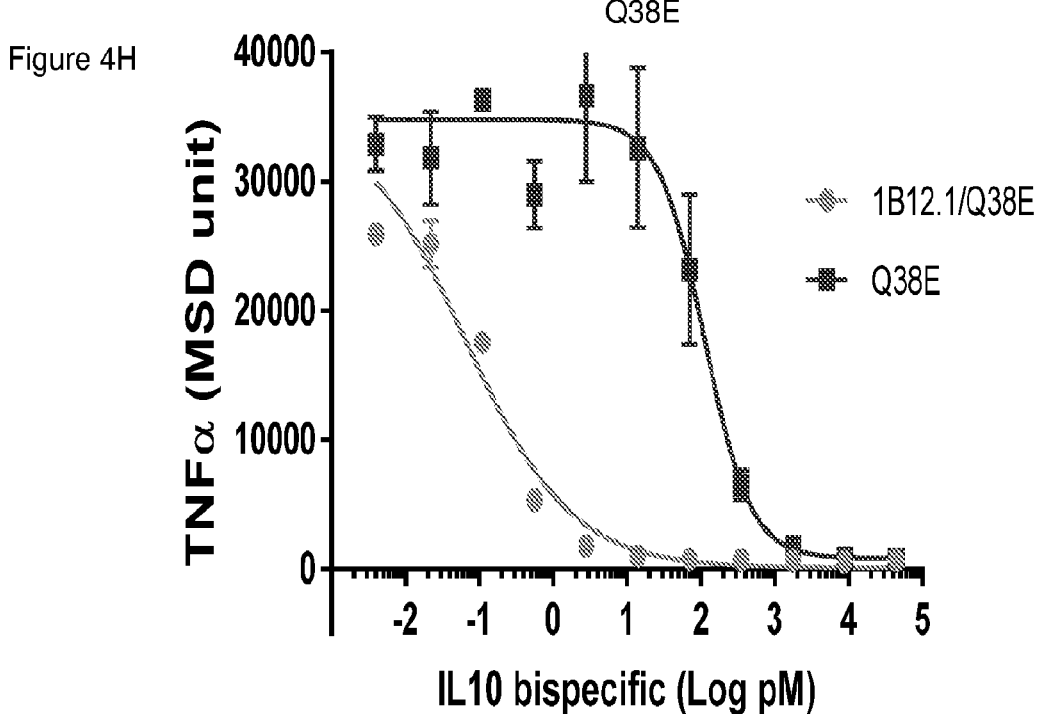
Figure 6A:
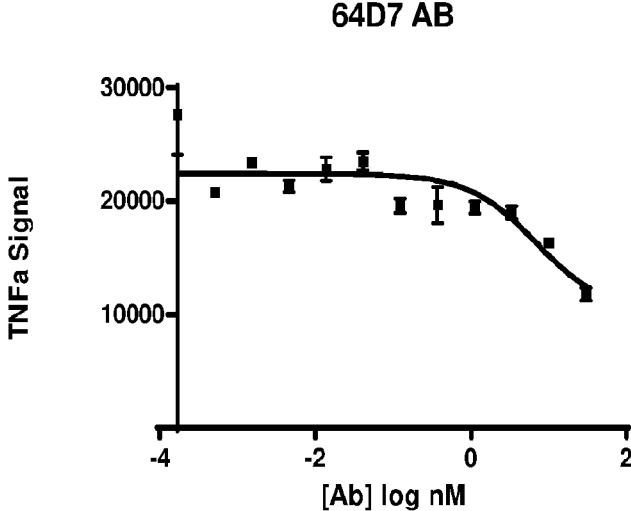
FIGS. 6A-6D shows inhibition of ligand (PGLYRP1/PGN) mediated TREM-1 signaling by anti-human TREM-1 antibodies in human (FIG. 6C-6D) or cyno (FIG. 6A-6B) PBMCs as measured by TNF alpha release.
Figure 6B:
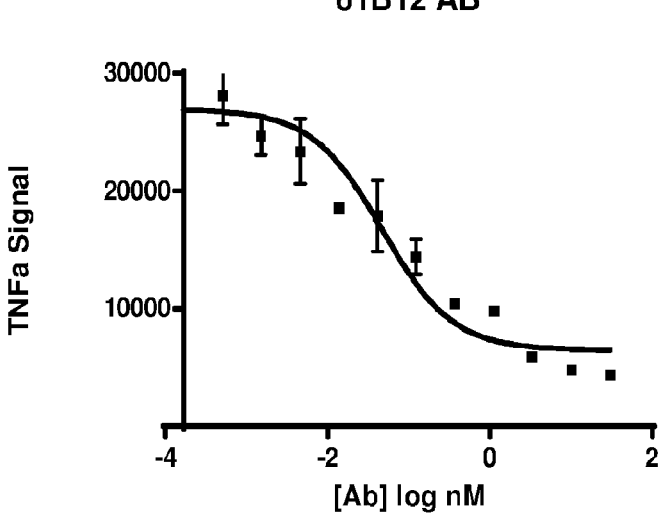
Figure 6C:
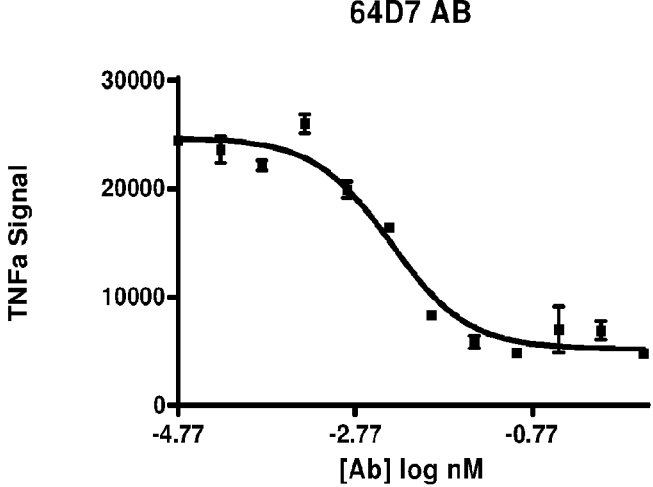
Figure 6D:
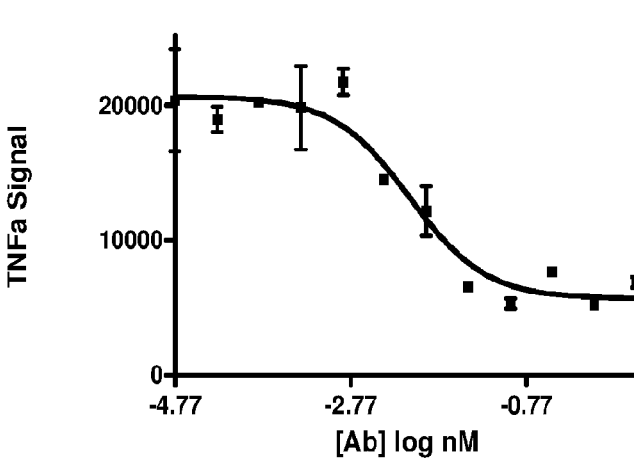

The effects of IL-10, IL-10 mutein and IL-10/anti-TREM-1 antigen binding proteins on immune cell activity was assessed using a whole blood assay. Fresh heparinized human whole blood obtained from healthy non-medicated donors was aliquoted into 96-well 2.0 mL deep well plates. Plates containing blood were equilibrated to 37° C. for at least 30 min prior to adding IL10 reagents. Indicated test reagents were serial diluted and added to the whole blood. Plates were incubated for 30 min at 37° C. Plates were then placed on ice and added with staining antibodies against CD3 (clone UCHT-1) and CD4 (clone RPA-T4) for 10 minutes incubation. Cells were then treated with 1.4 mL of BD fix/lyse buffer and incubated to 37° C. for 20 minutes. Cells were washed with 2% FCS/PBS until the lysed RBC's were cleared. To permeabilize the cells, 200 μL of ice-cold BD Perm buffer III was added to each well and mixed thoroughly. After washing 5 times, CD20 (clone H1), CD14 (clone RM052) and pSTAT3 pY705 (clone 4/P-STAT3) were added to the cells. After incubation on a plate shaker at 200-300 RPM for one hour at ambient temperature covered with aluminum foil to protect from light, unbound antibody was promptly removed by washing 2 times with 2% FCS/PBS. Cells were resuspended in 200 μL 2% FCS/PBS wash buffer and subjected to FACS analysis using a BD LSRII flow cytometer. While IL-10 alone induced CD8++ T cell and B cell proliferation, there was no increased CD8+T cell and B cell activation induced by IL-10 mutein or anti-TREM-1/IL-10 mutein, and an anti-TREM-1 mAb/IL-10 mutein demonstrated proof of concept of cell type specific targeting effect (FIG. 3).

Inhibition of LPS-induced TNFα production from human monocytes was assessed. Monocytes were isolated from frozen PBMCs using Miltenyi Monocyte isolation kit II. Purified monocytes were plated in complete media at $10^5$ cells per well in 96 round well TC treated plate. Indicated test proteins with various IL-10 muteins were serial diluted 1:5 from 11000 pM to 0.005 pM. LPS was added to the cells at final concentration of 10 ng/mL. Plates were incubated overnight at 5.0% $CO_2$, 37° C. TNFα in cell supernatant was measured using the MSD Vplex human TNFα detection kits. FIGS. 4A-4H demonstrate that antigen binding proteins having different IL-10 muteins are more potent at diminishing TNFα in monocytes compared to culture with IL-10 mutein alone, suggesting that TREM-1 binding significantly enhanced IL-10 mutein suppression of monocyte activation.

To assess inhibition of LPS-induced human TNFα production in human monocytes, monocytes were isolated from frozen PBMCs using Miltenyi Monocyte isolation kit II. Purified monocytes were plated in complete media at $10^5$ cells per well in 96 round well TC treated plate. Indicated test proteins were serial diluted 1:5 from 11000 pM to 0.005 pM. LPS was added to the cells at final concentration of 10 ng/mL Plates were incubated overnight at 5.0% $CO_2$, 37° C. TNFα in cell supernatant was measured using the MSD Vplex human TNFα detection kits. To assess inhibition of LPS-induced mouse TNFα production, mouse bone marrow was isolated from the femur of C57B1I/6 mice. Cells were plated in complete media at 105 per well into a 96 round well TC treated plate. Indicated test reagents were serial diluted 1:5 from 11000 pM to 0.005 pM. LPS was added to the cells at final concentration of 10 ng/mL. Plates were incubated overnight at 5.0% $CO_2$, 37° C. Mouse TNFα in the supernatant was measured using the MSD Vplex mouse TNFα detection kits.

FIG. 5 shows that there is significant improvement of IL-10 mutein potency on inhibition of TNFα in human monocytes through TREM-1 binding (FIG. 5A). The improvement of TNF inhibition on monocytes is dependent on TREM-1 binding as there is little potency against mouse monocytes due to lack of cross-reactivity with mouse TREM-1 (FIG. 5B).

These results demonstrate that an antigen binding protein comprising an IL-10 mutein and an immune cell targeting moiety, e.g., an anti-TREM-1 antibody, is capable of differentially regulating immune cells compared to wild type IL-10. The antigen binding protein significantly inhibits TNF-α production from myeloid cells. The antigen binding protein does not stimulate CD8+ T cells and B cells. The IL-10 mutein antigen binding protein is able suppress inflammation without stimulating immune cells, and therefore can provide therapeutic benefit in treating inflammatory bowel disease.

Example 5-Stability Engineering of IL-10M1

For yeast display stability engineering of IL-10M1 (SEQ ID NO: 2211) using an unbiased approach, an error-prone PCR-based library of IL-10M1 was generated under low mutagenesis conditions using GENEMORPH® II kit and displayed on yeast (IL10M1-EP Library). The library was displayed on the surface of yeast derivative of BJ5464, wherein IL-10M1 was fused to the N-terminus of alpha-agglutin. Efficiency of display was measured by binding of ALEXAFLUOR® 647 conjugated anti-HA antibody.

Libraries were sorted using fluorescence activated cell sorting (FACS) for high binding to biotin conjugated recombinant IL-10R-Fc using streptavidin PE as fluorescence secondary.

To identify mutants that performed better than wild-type IL-10M1 under stress conditions, various stresses were applied to this error-prone yeast library. As a stress for protein expression, IL-10M1-EP library of yeast cells were induced to display IL-10M1 mutant variants at 20 or 30° C. To identify mutants that show higher resistance to this stress, variants that bound well to IL-10R-Fc and displayed well on yeast surface (assessed by the HA epitope tag) were sorted by FACS. IL-10M1 sequences from these enriched binder pools, along with the initial IL-10M1 EP Library pool, were amplified by primers outside the IL-10M1 coding sequence. Amplicons were then processed using Nextera library preparation kit and submitted to NGS analysis on an Illumina MiSeq for a 2×300 bp run. Mutant sequences that were highly enriched or depleted in the binder pool after 30C induction stress were selected to be made recombinantly and evaluated for stability in order to assess the predictive power of the approach (Table 15).

To identify variants that may be better folded and less exposed to proteolysis, limited proteolysis experiments were performed. First, IL-10M1 error-prone library was induced at 20° C. and FACS sorted to eliminate non-IL10R binders. This yielded the IL-10M1 EP binder library. Then, IL-10M1 EP binder library was induced 20° C. and subjected to limiting amounts of trypsin, chymotrypsin and thermolysin. To identify mutants that show higher resistance to these proteases, variants that bound to IL-10R-Fc and displayed on yeast surface better than the parent IL-10M1 molecule were sorted by FACS and analyzed by NGS as described above. Mutant sequences that were highly enriched or depleted in protease resistant pools (e.g., protein stress enriched, temp stress enriched, temp and protease stress enriched, protease stress depleted, or temp stress depleted) were selected to be made recombinantly and evaluated for stability in order to assess the predictive power of the approach (Table 16).

TABLE 16

| Yeast display selected stability mutations and rationale | | | |
|---|---|---|---|
| TREM1 61B12 IL-10 fusion Clone | SEQ ID NO: | IL-10 mutein | SEQ ID NO: |
| TREM1_61B12.001_G4S_huIL10[K130Q,K138D] | 2137 | huIL10[K130Q,K138D] | 2138 |
| TREM1_61B12.001_G4S_huIL10[K130Q] a | 2139 | huIL10[K130Q] | 2140 |
| TREM1_61B12.001_G4S_huIL10[K138D,K157N] | 2141 | huIL10[K138D,K157N] | 2142 |
| TREM1_61B12.001_G4S_huIL10[K138D,M154V] | 2143 | huIL10[K138D,M154V] | 2144 |
| TREM1_61B12.001_G4S_huIL10[K138D,N160D] | 2145 | huIL10[K138D,N160D] | 2146 |
| TREM1_61B12.001_G4S_huIL10[K138D,linker[G1A]] | 2147 | huIL10[K138D,linker[G1A]] | 2148 |
| TREM1_61B12.001_G4S_huIL10[K138D,linker[G1V]] | 2149 | huIL10[K138D,linker[G1V]] | 2150 |
| TREM1_61B12.001_G4S_huIL10[K138D,linker[G5A]] | 2151 | huIL10[K138D,linker[G5A]] | 2152 |
| TREM1_61B12.001_G4S_huIL10[K157N] b | 2153 | huIL10[K157N] | 2154 |
| TREM1_61B12.001_G4S_huIL10[M154V] a | 2155 | huIL10[M154V] | 2156 |
| TREM1_61B12.001_G4S_huIL10[N160D] a | 2157 | huIL10[N160D] | 2158 |
| TREM1_61B12.001_G4S_huIL10[linker[G1A]] a | 2159 | huIL10[linker[G1A]] | 2160 |
| TREM1_61B12.001_G4S_huIL10[linker[G1V]] e | 2161 | huIL10[linker[G1V]] | 2162 |
| TREM1_61B12.001_G4S_huIL10[linker[G5A]] b | 2163 | huIL10[linker[G5A]] | 2164 |
| TREM1_61B12.001_G4S_huIL10[A89P]b | 2165 | huIL10[A89P]b | 2166 |
| TREM1_61B12.001_G4S_huIL10[A89P,K138D] | 2167 | huIL10[A89P,K138D] | 2168 |
| TREM1_61B12.001_G4S_huIL10[E115K] a | 2169 | huIL10[E115K] | 2170 |
| TREM1_61B12.001_G4S_huIL10[E115K,K138D] | 2171 | huIL10[E115K,K138D] | 2172 |
| TREM1_61B12.001_G4S_huIL10[F56Y] b | 2173 | huIL10[F56Y] | 2174 |
| TREM1_61B12.001_G4S_huIL10[F56Y,K138D] | 2175 | huIL10[F56Y,K138D] | 2176 |
| TREM1_61B12.001_G4S_huIL10[H109D] a | 2177 | huIL10[H109D] | 2178 |
| TREM1_61B12.001_G4S_huIL10[H109D,K138D] | 2179 | huIL10[H109D,K138D] | 2180 |
| TREM1_61B12.001_G4S_huIL10[H14Q,L46K] | 2181 | huIL10[H14Q,L46K] | 2182 |

TABLE 16-continued

| Yeast display selected stability mutations and rationale | | | |
|---|---|---|---|
| TREM1 61B12 IL-10 fusion Clone | SEQ ID NO: | IL-10 mutein | SEQ ID NO: |
| TREM1_61B12.001_G4S_huIL10[H14Q,Q38E] | 2359 | huIL 10[H14Q,Q38E] | 2360 |
| TREM1_61B12.001_G4S_huIL10[H14Q] a | 2361 | huIL10[H14Q] | 2362 |
| TREM1_61B12.001_G4S_huIL10[H14Q,K138D] | 2363 | huIL10[H14Q,K138D] | 2364 |
| TREM1_61B12.001_G4S_huIL10[K57N] b | 2365 | huIL10[K57N] | 2366 |
| TREM1_61B12.001_G4S_huIL10[K57N,K138D] | 2367 | huIL10[K57N,K138D] | 2368 |
| TREM1_61B12.001_G4S_huIL10[L112V] d | 2369 | huIL10[L112V] | 2370 |
| TREM1_61B12.001_G4S_huIL10[L112V,K138D] | 2371 | huIL10[L112V,K138D] | 2372 |
| TREM1_61B12.001_G4S_huIL10[L46K,A89P] | 2373 | huIL10[L46K,A89P] | 2374 |
| TREM1_61B12.001_G4S_huIL10[L46K,E115K] | 2375 | huIL10[L46K, E115K] | 2376 |
| TREM1_61B12.001_G4S_huIL10[L46K,F56Y] | 2377 | huIL10[L46K,F56Y] | 2378 |
| TREM1_61B12.001_G4S_huIL10[L46K,H109D] | 2379 | huIL10[L46K,H109D] | 2380 |
| TREM1_61B12.001_G4S_huIL10[L46K,K57N] | 2381 | huIL10[L46K, K57N] | 2382 |
| TREM1_61B12.001_G4S_huIL10[L46K,L112V] | 2383 | huIL10[L46K,L112V] | 2384 |
| TREM1_61B12.001_G4S_huIL10[L46K,L60Q] | 2385 | huIL10[L46K,L60Q] | 2386 |
| TREM1_61B12.001_G4S_huIL10[L46K,N116D] | 2387 | huIL10[L46K,N116D] | 2388 |
| TREM1_61B12.001_G4S_huIL10[L46K,Q63E] | 2389 | huIL10[L46K,Q63E] | 2390 |
| TREM1_61B12.001_G4S_huIL10[L46K,Q63L] | 2391 | huIL10[L46K,Q63L] | 2392 |
| TREM1_61B12.001_G4S_huIL10[L46K,Q70E] | 2393 | huIL10[L46K,Q70E] | 2394 |
| TREM1_61B12.001_G4S_huIL10[L46K,Q70K] | 2395 | huIl 10[L46K,Q70K] | 2396 |
| TREM1_61B12.001_G4S_huIL10[L46K,R110P] | 2397 | huIL10[L46K, R110P] | 2398 |
| TREM1_61B12.001_G4S_huIL10[L46K,R110Q] | 2399 | huIL10[L46K, R110Q] | 2400 |
| TREM1_61B12.001_G4S_huIL10[L46K] | 2401 | huIL10[L46K] | 2402 |
| TREM1_61B12.001_G4S_huIL10[L46K,linker[G1V]] | 2403 | huIL10[L46K,linker[G1V]] | 2404 |
| TREM1_61B12.001_G4S_huIL10[L46K, linker[G5A] | 2405 | huIL10[L46K, linker[G5A]] | 2406 |
| TREM1_61B12.001_G4S_huIL10[L46K,K130Q] | 2407 | huIL10[L46K,K130Q] | 2408 |
| TREM1_61B12.001_G4S_huIL10[L46K,K157N] | 2409 | huIL10[L46K,K157N] | 2410 |
| TREM1_61B12.001_G4S_huIL10[L46K,M154V] | 2411 | huIL10[L46K,M154V] | 2412 |
| TREM1_61B12.001_G4S_huIL10[L46K,N160D] | 2143 | huIL10[L46K,N160D] | 2414 |
| TREM1_61B12.001_G4S_huIL10[L60Q] c | 2415 | huIL10[L60Q] | 2416 |
| TREM1_61B12.001_G4S_huIL10[L60Q,K138D] | 2417 | huIL10[L60Q,K138D] | 2418 |
| TREM1_61B12.001_G4S_huIL10[M22V,L46K] | 2419 | huIL10[M22V,L46K] | 2420 |
| TREM1_61B12.001_G4S_huIL10[M22V,Q38E] | 2421 | huIL10[M22V,Q38E] | 2422 |
| TREM1_61B12.001_G4S_huIL10[M22V] a | 2423 | huIL10[M22V] | 2424 |
| TREM1_61B12.001_G4S_huIL10[M22V,K138D] | 2425 | huIL10[M22V,K138D] | 2426 |
| TREM1_61B12.001_G4S_huIL10[N116D] b | 2427 | huIL10[N116D] | 2428 |
| TREM1_61B12.001_G4S_huIL10[N116D,K138D] | 2429 | huIL10[N116D,K138D] | 2430 |
| TREM1_61B12.001_G4S_huIL10[Q38E,A89P] | 2431 | huIL10[Q38E,A89P] | 2432 |
| TREM1_61B12.001_G4S_huIL10[Q38E,E115K] | 2433 | huIL10[Q38E,E115K] | 2434 |
| TREM1_61B12.001_G4S_huIL10[Q38E,F56Y] | 2435 | huIL10[Q38E,F56Y] | 2436 |
| TREM1_61B12.001_G4S_huIL10[Q38E,H109D] | 2437 | huIL10[Q38E,H109D] | 2438 |
| TREM1_61B12.001_G4S_huIL10[Q38E,K57N] | 2439 | huIL10[Q38E,K57N] | 2440 |
| TREM1_61B12.001_G4S_huIL10[Q38E,L112V] | 2441 | huIL10[Q38E,L112V] | 2442 |
| TREM1_61B12.001_G4S_huIL10[Q38E,L60Q] | 2443 | huIL10[Q38E,L60Q] | 2444 |
| TREM1_61B12.001_G4S_huIL10[Q38E,N116D] | 2445 | huIL10[Q38E,N116D] | 2446 |
| TREM1_61B12.001_G4S_huIL10[Q38E,Q63E] | 2447 | huIL10[Q38E,Q63E] | 2448 |
| TREM1_61B12.001_G4S_huIL10[Q38E,Q63L] | 2449 | huIL10[Q38E,Q63L] | 2450 |
| TREM1_61B12.001_G4S_huIL10[Q38E,Q70E] | 2451 | huIL10[Q38E,Q70E] | 2452 |
| TREM1_61B12.001_G4S_huIL10[Q38E,Q70K] | 2453 | huIL10[Q38E,Q70K] | 2454 |
| TREM1_61B12.001_G4S_huIL10[Q38E,R110P] | 2455 | huIL10[Q38E,R110P] | 2456 |
| TREM1_61B12.001_G4S_huIL10[Q38E,R110Q] | 2457 | huIL10[Q38E,R110Q] | 2458 |
| TREM1_61B12.001_G4S_huIL10[Q38E,linker[G5A]] | 2459 | huIL10[Q38E,linker[G5A]] | 2460 |
| TREM1_61B12.001_G4S_huIL10[Q38E,linker[G1V]] | 2461 | huIL10[Q38E,linker[G1V] | 2462 |
| TREM1_61B12.001_G4S_huIL10[Q38E,linker[G1A]] | 2463 | huIL10[Q38E,linker[G1A]] | 2464 |
| TREM1_61B12.001_G4S_huIL10[Q38E,K130Q] | 2465 | huIL10[Q38E,K130Q] | 2466 |
| TREM1_61B12.001_G4S_huIL10[Q38E,K157N] | 2467 | huIL10[Q38E,K157N] | 2468 |
| TREM1_61B12.001_G4S_huIL10[Q38E,M154V] | 2469 | huIL10[Q38E,M154V] | 2470 |
| TREM1_61B12.001_G4S_huIL10[Q63E] c | 2471 | huIL10[Q63E] | 2472 |
| TREM1_61B12.001_G4S_huIL10[Q63E,K138D] | 2473 | huIL 10[Q63E,K138D] | 2474 |
| TREM1_61B12.001_G4S_huIL10[Q63L,Q138L] | 2475 | huIL10[Q63L,Q138L] | 2476 |
| TREM1_61B12.001_G4S_huIL10[Q63L,K138D] | 2477 | huIL10[Q63L,K138D] | 2478 |
| TREM1_61B12.001_G4S_huIL10[Q70E] a | 2479 | huIL10[Q70E] | 2480 |
| TREM1_61B12.001_G4S_huIL10[Q70E,K138D] | 2481 | huIL10[Q70E,K138D] | 2482 |
| TREM1_61B12.001_G4S_huIL10[Q70K] d | 2483 | huIL10[Q70K] | 2484 |
| TREM1_61B12.001_G4S_huIL10[Q70K,K138D] | 2485 | huIL10[Q70K,K138D] | 2486 |
| TREM1_61B12.001_G4S_huIL10[R110P] c | 2487 | huIL10[R110P] | 2488 |
| TREM1_61B12.001_G4S_huIL10[R110P,K138D] | 2489 | huIL10[R110P,K138D] | 2490 |
| TREM1_61B12.001_G4S_huIL10[R110Q] c | 2491 | huIL10[R110Q] | 2492 |
| TREM1_61B12.001_G4S_huIL10[K120D] | 2493 | huIL10[K120D] | 2494 |
| TREM1_61B12.001_G4S_huIL10[Q63L] d | 2495 | huIL10[Q63L] | 2496 |

Rationale for selection: a, protein stress enriched; b, temp stress enriched; c, temp and protease stress enriched; d, protease stress depleted; e, temp stress depleted Rosetta Stability Engineering: Stability engineering was also explored through computational design. Structural modeling of the IL10M1 muteins was performed using RosettaScripts and the Talaris2014 score function. Using the "fastrelax" protocol, five cycles of backbone minimization and rotamer optimization brought monomeric IL-M models derived from the PDB 1Y6K crystal structure to a local energy minimum. After relaxation, residues 21-161 were individually screened and computationally mutated to each of the 20 standard amino acids. This was followed by 50 Monte Carlo based simulated annealing steps for the peptide backbone and surrounding residues. All selected designs were also remodeled and scored in the background of the L46K attenuation mutation to confirm predicted behavior was uninfluenced. Table 17 shows the SEQ ID NOS for the IL10 mutein fusion with the heavy chain of antibody 61B2; the light chain in each is the same as in antibody 61B12 (SEQ ID NO: 105, but lacking the signal sequence).

TABLE 17

Rosetta stability clones

| Rosetta Stability Engineering Clones | IL10 61B12 fusion AA SEQ ID NO. | IL10 mutein AA SEQ ID NO |
|---|---|---|
| huIL10[L46K]_mono_G4S_TREM1_61B12.001 | 2497 | 8 |
| huIL10[L46K]_bi_G4S_TREM1_61B12.001 | 2498 | 8 |
| TREM1_61B12.001_G4S_huIL10[F15Y,L46K] | 2499 | 2500 |
| TREM1_61B12.001_G4S_huIL10[K40C,L46K,Y137C] | 2501 | 2502 |
| TREM1_61B12.001_G4S_huIL10[L46K,D84R] | 2503 | 2504 |
| TREM1_61B12.001_G4S_huIL10[L46K,E67C,V121C] | 2505 | 2506 |
| TREM1_61B12.001_G4S_huIL10[L46K,H90E] | 2507 | 2508 |
| TREM1_61B12.001_G4S_huIL10[L46K,H90Q] | 2509 | 2510 |
| TREM1_61B12.001_G4S_huIL10[L46K, K49S] | 2511 | 2512 |
| TREM1_61B12.001_G4S_huIL10[L46K,K49T] | 2513 | 2514 |
| TREM1_61B12.001_G4S_huIL10[L46K,K57C,M156C] | 2515 | 2516 |
| TREM1_61B12.001_G4S_huIL10[L46K,L103E] | 2517 | 2518 |
| TREM1_61B12.001_G4S_huIL10[L46K,M77R] | 2519 | 2520 |
| TREM1_61B12.001_G4S_huIL10[L46K,M77V] | 2521 | 2522 |
| TREM1_61B12.001_G4S_huIL10[L46K,Q79C,I136C] | 2523 | 2524 |
| TREM1_61B12.001_G4S_huIL10[L46K,Q79R] | 2525 | 2526 |
| TREM1_61B12.001_G4S_huIL10[L46K,S93E] | 2527 | 2528 |
| TREM1_61B12.001_G4S_huIL10[L46K,S93Q] | 2529 | 2530 |
| TREM1_61B12.001_G4S_huIL10[L46K,T100R] | 2531 | 2532 |
| TREM1_61B12.001_G4S_huIL10[L46K,Y59T] | 2533 | 2534 |
| TREM1_61B12.001_G4S_huIL10[L46K,A127M] | 2535 | 2536 |
| TREM1_61B12.001_G4S_huIL10[L46K]_mono | 2537 | 2538 |
| TREM1_61B12.001_G4S_huIL10[Q38C,L46K,S141C] | 2539 | 2540 |

To select for designs with improved stability and surface properties, final models were ranked relative to each other using the Talaris2014 score and hydrophobic Solvent Accessible Surface Area (hSASA). 15 well-scoring designs with low energies and reduced hSASA were ultimately selected for experimental evaluation (Table 18).

TABLE 18

Rosetta Energy Scores of Top 15 Point Mutations

| Mutation | total_score | hsasa_list |
|---|---|---|
| Y59T | −0.93 | −52.55 |
| M77R | −3.10 | −51.16 |
| M77V | −2.39 | −53.92 |
| D84R | −1.03 | −44.39 |
| H90E | −1.47 | −38.28 |
| H90Q | −0.69 | −30.08 |

TABLE 18-continued

Rosetta Energy Scores of Top 15 Point Mutations

| Mutation | total_score | hsasa_list |
|---|---|---|
| K49T | −0.83 | −25.75 |
| K49S | −0.63 | −31.50 |
| A127M | −0.65 | −25.60 |
| F15Y | −0.42 | −23.10 |
| S93E | −1.84 | −19.97 |
| S93Q | −1.25 | −15.71 |
| L103E | −0.87 | −17.12 |
| T100R | −1.19 | −11.25 |
| Q79R | −1.42 | −10.33 |

An alternative rational design strategy explored introducing disulfides to stabilize the forced-monomeric structure of IL10M1. For this method, residues 21-123 in the template model were screened for proximity to residues 124-165. Residue pairs were computationally mutated to cysteines and forced into a disulfide if the Cβ atoms were within 6.5 Å of each other. These designs were ranked relative to each other using the Talaris2014 score and the unweighted disulfide potential term. 5 cross-linking designs with low energies were thus selected for experimental evaluation (Table 19).

TABLE 19

Rosetta energy scores of top 5 disulfide mutations

| Mutation | total_score | dslf_fa13 |
|---|---|---|
| Q97C-I136C | 5.62 | −0.43 |
| K57C-M156C | 5.64 | 1.53 |
| K40C-Y137C | 5.69 | −0.56 |
| Q38C-S141C | 6.27 | −0.38 |
| E67C-V121C | 6.37 | −0.43 |

Production and testing as bispecific fusions: Mutein variants designed for increased stability were cloned as bivalent C-terminal fusions to anti-TREM1 antibody 61B2.001, expressed recombinantly in CHO cells, and purified as described in Example 3. The identity of each variant was confirmed by intact mass spectrometry, and each was concentrated to 10±1 mg/mL using Slide-A-Lyzer™ G2 Dialysis Cassettes, 20K MWCO, 3 mL (ThermoFisher cat. #87735). The expression titer in conditioned medium was measured by ForteBio OCTET® (Pall Life Sciences) using Protein A sensors. The percent of high molecular weight (% HMW) material present was measured by analytical size exclusion chromatography (SEC), and the % target protein purity was measured by non-reduced microcapillary electrophoresis using a LABCHIP® GXII (Perkin Elmer). Aggregation propensity and monomer stability were evaluated by stressing samples at 40° C. 2 weeks. Stressed and TO samples were then analyzed by analytical SEC to quantify increases in aggregation (% HMW) and loss of monomer post stress versus TO. Bispecific functional activity was measured by inhibition of TNFα production in LPS-stimulated PBMCs on a subset of molecules; results for selected molecules are shown in Table 20.

TABLE 20

| | | | | | | |
|---|---|---|---|---|---|---|
| Production and stability data for fusions of engineered IL-10M1 muteins to anti-TREM1 antibody 61B2 | | | | | | |
| Name | Titer (mg/L) | Final Yield (mg/L) | SEC pre-MP (%) | purity MCE NR (%) | Delta % HMW (2 wk 40 C.) | Delta % Main Peak (2 wk 40 C.) |
| huIL10[L46K]_mono_G4S_TREM1_61B12.001 | 140 | NA | ND | ND | ND | ND |
| huIL10[L46K]_bi_G4S_TREM1_61B12.001 | 145 | 56 | 5.9 | 99.8 | 1.7 | 8.1 |
| TREM1_61B12.001_G4S_huIL10[F15Y, L46K] | 161 | 107 | 5.3 | 98.0 | 2.2 | 1.4 |
| TREM1_61B12.001_G4S_huIL10[K40C, L46K, Y137C] | 177 | 101 | 5.3 | 99.4 | 2.6 | 1.5 |
| TREM1_61B12.001_G4S_huIL10[L46K, D84R] | 198 | NA | ND | ND | ND | ND |
| TREM1_61B12.001_G4S_huIL10[L46K, E67C, V121C] | 147 | NA | ND | ND | ND | ND |
| TREM1_61B12.001_G4S_huIL10[L46K, H90E] | 171 | 121 | 6.6 | 98.8 | 1.8 | 0.6 |
| TREM1_61B12.001_G4S_huIL10[L46K, H90Q] | 158 | 38 | 5.5 | 99.2 | 1.3 | 0.5 |
| TREM1_61B12.001_G4S_huIL10[L46K, K49S] | 181 | 121 | 7.3 | 99.3 | 0.8 | −0.4 |
| TREM1_61B12.001_G4S_huIL10[L46K, K49T] | 192 | 98 | 11.9 | 99.2 | −2.9 | −3.8 |
| TREM1_61B12.001_G4S_huIL10[L46K, K57C, M156C] | 155 | 115 | 5.4 | 99.1 | 1.9 | 1.2 |
| TREM1_61B12.001_G4S_huIL10[L46K, L103E] | 163 | 147 | 3.9 | 99.4 | 0.6 | 0.2 |
| TREM1_61B12.001_G4S_huIL10[L46K, M77R] | 198 | NA | ND | ND | ND | ND |
| TREM1_61B12.001_G4S_huIL10[L46K, M77V] | 182 | 99 | 5.4 | 99.6 | 5.2 | 3.5 |
| TREM1_61B12.001_G4S_huIL10[L46K, Q79C, I136C] | 182 | 97 | 5.2 | 99.1 | 1.4 | 0.9 |
| TREM1_61B12.001_G4S_huIL10[L46K, Q79R] | 167 | 111 | 7.1 | 97.2 | 0.6 | −0.1 |
| TREM1_61B12.001_G4S_huIL10[L46K, S93E] | 183 | 123 | 6.4 | 99.1 | 1.8 | 1.0 |
| TREM1_61B12.001_G4S_huIL10[L46K, S93Q] | 162 | 80 | 6.4 | 99.5 | 1.0 | 0.4 |
| TREM1_61B12.001_G4S_huIL10[L46K, T100R] | 169 | NA | ND | ND | ND | ND |
| TREM1_61B12.001_G4S_huIL10[L46K, Y59T] | 163 | 100 | 5.5 | 99.4 | 0.1 | 0.0 |
| TREM1_61B12.001_G4S_huIL10[L46K, A127M] | 190 | 114 | 5.1 | 99.0 | 1.9 | 1.2 |
| TREM1_61B12.001_G4S_huIL10[L46K]_mono | 163 | 67 | 2.7 | 66.7 | 1.1 | 0.7 |
| TREM1_61B12.001_G4S_huIL10[Q38C, L46K, S141C] | 167 | 81 | 5.1 | 100.0 | 1.2 | 0.7 |
| TREM1_61B12.001_G4S_huIL10[K130Q, K138D] | ND | ND | ND | ND | ND | ND |
| TREM1_61B12.001_G4S_huIL10[K130Q] | 164 | ND | ND | ND | ND | ND |
| TREM1_61B12.001_G4S_huIL10[K138D, K57N] | ND | ND | ND | ND | ND | ND |
| TREM1_61B12.001_G4S_huIL10[K138D, M154V] | ND | ND | ND | ND | ND | ND |
| TREM1_61B12.001_G4S_huIL10[K138D, N160D] | ND | ND | ND | ND | ND | ND |
| TREM1_61B12.001_G4S_huIL10[K138D, linker[G1A]] | ND | ND | ND | ND | ND | ND |
| TREM1_61B12.001_G4S_huIL10[K138D, linker[G1V]] | ND | ND | ND | ND | ND | ND |
| TREM1_61B12.001_G4S_huIL10[K138D, linker[G5A]] | ND | ND | ND | ND | ND | ND |
| TREM1_61B12.001_G4S_huIL10[K57N] | 155 | 75 | 5.4 | 93.4 | 36.5 | 22.4 |
| TREM1_61B12.001_G4S_huIL10[M154V] | 173 | ND | ND | ND | ND | ND |
| TREM1_61B12.001_G4S_huIL10[N160D] | ND | ND | ND | ND | ND | ND |
| TREM1_61B12.001_G4S_huIL10[linker[G1A]] | 167 | 50 | 5.6 | 97.8 | ND | ND |
| TREM1_61B12.001_G4S_huIL10[linker[G1V] | 166 | ND | ND | ND | ND | ND |
| TREM1_61B12.001_G4S_huIL10[linker[G5A]] | 170 | ND | ND | ND | ND | ND |
| TREM1_61B12.001_G4S_huIL10[A89P] | 163 | ND | ND | ND | ND | ND |
| TREM1_61B12.001_G4S_huIL10[A89P, K138D] | ND | ND | ND | ND | ND | ND |
| TREM1_61B12.001_G4S_huIL10[E115K] | 121 | ND | ND | ND | ND | ND |
| TREM1_61B12.001_G4S_huIL10[E115K, K138D] | ND | ND | ND | ND | ND | ND |
| TREM1_61B12.001_G4S_huIL10[F56Y] | 105 | ND | ND | ND | ND | ND |
| TREM1_61B12.001_G4S_huIL10[F56Y, K138D] | ND | ND | ND | ND | ND | ND |
| TREM1_61B12.001_G4S_huIL10[H109D] | 139 | ND | ND | ND | ND | ND |
| TREM1_61B12.001_G4S_huIL10[H109D, K138D] | ND | ND | ND | ND | ND | ND |
| TREM1_61B12.001_G4S_huIL10[H14Q, L46K] | 139 | 68 | 5.9 | 99.1 | 3.5 | 2.1 |
| TREM1_61B12.001_G4S_huIL10[H14Q, Q38E] | ND | ND | ND | ND | ND | ND |
| TREM1_61B12.001_G4S_huIL10[H14Q] | 141 | 62 | 4.6 | 99.7 | 8.7 | 4.8 |
| TREM1_61B12.001_G4S_huIL10[H14Q, K138D] | ND | ND | ND | ND | ND | ND |
| TREM1_61B12.001_G4S_huIL10[K57N] | 155 | 75 | 5.4 | 93.4 | 36.5 | 22.4 |
| TREM1_61B12.001_G4S_huIL10[K57N, K138D] | ND | ND | ND | ND | ND | ND |
| TREM1_61B12.001_G4S_huIL10[L112V] | 156 | 26 | 5.7 | 97.5 | ND | ND |
| TREM1_61B12.001_G4S_huIL10[L112V, K138D] | ND | ND | ND | ND | ND | ND |
| TREM1_61B12.001_G4S_huIL10[L46K, A89P] | 167 | 80 | 7.1 | 96.7 | 3.3 | 1.8 |
| TREM1_61B12.001_G4S_huIL10[L46K, E115K] | 155 | ND | ND | ND | ND | ND |
| TREM1_61B12.001_G4S_huIL10[L46K, F56Y] | 136 | ND | ND | ND | ND | ND |
| TREM1_61B12.001_G4S_huIL10[L46K, H109D] | 163 | 70 | 4.1 | 98.0 | 2.9 | 2.0 |
| TREM1_61B12.001_G4S_huIL10[L46K, K57N] | 164 | 68 | 7.5 | 96.0 | 8.4 | 5.3 |
| TREM1_61B12.001_G4S_huIL10[L46K, L112V] | 157 | 63 | 7.1 | 99.3 | 7.5 | #VALUE! |
| TREM1_61B12.001_G4S_huIL10[L46K, L60Q] | 164 | 30 | 7.7 | 97.8 | ND | ND |
| TREM1_61B12.001_G4S_huIL10[L46K, N116D] | 163 | 59 | 4.6 | 99.0 | 3.8 | 2.7 |

TABLE 20-continued

Production and stability data for fusions of engineered IL-10M1 muteins to anti-TREM1 antibody 61B2

| Name | Titer (mg/L) | Final Yield (mg/L) | SEC pre-MP (%) | purity MCE NR (%) | Delta % HMW (2 wk 40 C.) | Delta % Main Peak (2 wk 40 C.) |
|---|---|---|---|---|---|---|
| TREM1_61B12.001_G4S_huIL10[L46K, Q63E] | 159 | 47 | 3.9 | 98.2 | ND | ND |
| TREM1_61B12.001_G4S_huIL10[L46K, Q63L] | 138 | ND | ND | ND | ND | ND |
| TREM1_61B12.001_G4S_huIL10[L46K, Q70E] | 165 | 72 | 5.2 | 98.6 | 7.8 | 4.9 |
| TREM1_61B12.001_G4S_huIL10[L46K, Q70K] | 146 | ND | ND | ND | ND | ND |
| TREM1_61B12.001_G4S_huIL10[L46K, R110P] | 157 | ND | ND | ND | ND | ND |
| TREM1_61B12.001_G4S_huIL10[L46K, R110Q] | 154 | ND | ND | ND | ND | ND |
| TREM1_61B12.001_G4S_huIL10[L46K] | 172 | 53 | 6.0 | 99.8 | 3.3 | 2.5 |
| TREM1_61B12.001_G4S_huIL10[L46K, linker[G1V]] | 167 | 37 | 5.9 | 99.3 | ND | ND |
| TREM1_61B12.001_G4S_huIL10[L46K, linker[G5A]] | 171 | 80 | 6.1 | 97.5 | 4.1 | 1.8 |
| TREM1_61B12.001_G4S_huIL10[L46K, K130Q] | 167 | 95 | 6.5 | 98.1 | 6.1 | 3.4 |
| TREM1_61B12.001_G4S_huIL10[L46K, K157N] | 0 | ND | ND | ND | ND | ND |
| TREM1_61B12.001_G4S_huIL10[L46K, M154V] | 174 | ND | ND | ND | ND | ND |
| TREM1_61B12.001_G4S_huIL10[L46K, N160D] | 170 | 55 | 5.1 | 97.9 | ND | ND |
| TREM1_61B12.001_G4S_huIL10[L60Q] | 168 | 62 | 6.4 | 98.0 | ND | ND |
| TREM1_61B12.001_G4S_huIL10[L60Q, K138D] | ND | ND | ND | ND | ND | ND |
| TREM1_61B12.001_G4S_huIL10[M22V, L46K] | 168 | 73 | 6.3 | 96.3 | 4.8 | 19.6 |
| TREM1_61B12.001_G4S_huIL10[M22V, Q38E] | ND | ND | ND | ND | ND | ND |
| TREM1_61B12.001_G4S_huIL10[M22V] | 170 | 56 | 5.3 | 98.1 | ND | ND |
| TREM1_61B12.001_G4S_huIL10[M22V, K138D] | ND | ND | ND | ND | ND | ND |
| TREM1_61B12.001_G4S_huIL10[N116D] | 159 | 61 | 4.8 | 97.7 | 12.1 | 7.4 |
| TREM1_61B12.001_G4S_huIL10[N116D, K138D] | ND | ND | ND | ND | ND | ND |
| TREM1_61B12.001_G4S_huIL10[Q38E, A89P] | ND | ND | ND | ND | ND | ND |
| TREM1_61B12.001_G4S_huIL10[Q38E, E115K] | ND | ND | ND | ND | ND | ND |
| TREM1_61B12.001_G4S_huIL10[Q38E, F56Y] | ND | ND | ND | ND | ND | ND |
| TREM1_61B12.001_G4S_huIL10[Q38E, H109D] | ND | ND | ND | ND | ND | ND |
| TREM1_61B12.001_G4S_huIL10[Q38E, K57N] | ND | ND | ND | ND | ND | ND |
| TREM1_61B12.001_G4S_huIL10[Q38E, L112V] | ND | ND | ND | ND | ND | ND |
| TREM1_61B12.001_G4S_huIL10[Q38E, L60Q] | ND | ND | ND | ND | ND | ND |
| TREM1_61B12.001_G4S_huIL10[Q38E, N116D] | ND | ND | ND | ND | ND | ND |
| TREM1_61B12.001_G4S_huIL10[Q38E, Q63E] | ND | ND | ND | ND | ND | ND |
| TREM1_61B12.001_G4S_huIL10[Q38E, Q63L] | ND | ND | ND | ND | ND | ND |
| TREM1_61B12.001_G4S_huIL10[Q38E, Q70E] | ND | ND | ND | ND | ND | ND |
| TREM1_61B12.001_G4S_huIL10[Q38E, Q70K] | ND | ND | ND | ND | ND | ND |
| TREM1_61B12.001_G4S_huIL10[Q38E, R110P] | ND | ND | ND | ND | ND | ND |
| TREM1_61B12.001_G4S_huIL10[Q38E, R110Q] | ND | ND | ND | ND | ND | ND |
| TREM1_61B12.001_G4S_huIL10[Q38E, linker[G5A]] | ND | ND | ND | ND | ND | ND |
| TREM1_61B12.001_G4S_huIL10[Q38E, linker[G1V]] | ND | ND | ND | ND | ND | ND |
| TREM1_61B12.001_G4S_huIL10[Q38E, linker[G1A]] | ND | ND | ND | ND | ND | ND |
| TREM1_61B12.001_G4S_huIL10[Q38E, K130Q] | ND | ND | ND | ND | ND | ND |
| TREM1_61B12.001_G4S_huIL10[Q38E, K157N] | ND | ND | ND | ND | ND | ND |
| TREM1_61B12.001_G4S_huIL10[Q38E, M154V] | ND | ND | ND | ND | ND | ND |
| TREM1_61B12.001_G4S_huIL10[Q63E] | 173 | 94 | 3.9 | 95.6 | 11.7 | 7.1 |
| TREM1_61B12.001_G4S_huIL10[Q63E, K138D] | ND | ND | ND | ND | ND | ND |
| TREM1_61B12.001_G4S_huIL10[Q63L, Q138L] | ND | ND | ND | ND | ND | ND |
| TREM1_61B12.001_G4S_huIL10[Q63L, K138D] | ND | ND | ND | ND | ND | ND |
| TREM1_61B12.001_G4S_huIL10[Q70E] | 168 | 90 | 4.7 | 97.6 | 27.2 | 17.2 |
| TREM1_61B12.001_G4S_huIL10[Q70E, K138D] | ND | ND | ND | ND | ND | ND |
| TREM1_61B12.001_G4S_huIL10[Q70K] | 153 | ND | ND | ND | ND | ND |
| TREM1_61B12.001_G4S_huIL10[Q70K, K138D] | ND | ND | ND | ND | ND | ND |
| TREM1_61B12.001_G4S_huIL10[R110P] | 153 | 60 | 3.2 | 98.5 | 4.2 | 2.2 |
| TREM1_61B12.001_G4S_huIL10[R110P, K138D] | ND | ND | ND | ND | ND | ND |
| TREM1_61B12.001_G4S_huIL10[R110Q] | 152 | 91 | 3.6 | 96.7 | 8.4 | 5.1 |
| TREM1_61B12.001_G4S_huIL10[K120D] | ND | ND | ND | ND | ND | ND |

These results show that a subset of stability mutations were successful in reducing the extent of aggregation of anti-TREM1 antibody-IL10M1 fusion/antigen binding protein variants during purification and after 2 weeks of stress at 40 degrees C. at moderately high concentrations (10 mg/mL).

The best stability mutations were combined with mutations designed to remediate deamidation hotspots at positions N10, N116, and/or the first position of the GGSGG linker between the first and second domains of IL10M1 (called hereafter linker[G1]). The new IL10M1 variants were fused bivalently to the anti-TREM1 antibodies 63F8.001 and 64D7.001 heavy chain in three different positions: the N-terminus, the C-terminus, or buried between the Fab and the Fc.

TABLE 21

Deamidation Hot Spots in IL-10 Muteins

| IL-10 mutein | SEQ ID NO: |
|---|---|
| HUIL10[L46K,L103E,LINKER[G1A]] | 2777 |
| HUIL10[L46K,L103E,LINKER[G1V]] | 2778 |
| HUIL10[L46K,R110P,LINKER[G1A]] | 2779 |
| HUIL10[L46K,R110P] | 2780 |
| HUIL10[N101,L46K,L103E,LINKER[G1A]] | 2781 |

TABLE 21-continued

Deamidation Hot Spots in IL-10 Muteins

| IL-10 mutein | SEQ ID NO: |
|---|---|
| HUIL10[N101,L46K,L103E,LINKER[G1V]] | 2782 |
| HUIL10[N101,L46K,L103E,R110P,LINKER[G1A]] | 2783 |
| HUIL10[N101,L46K,L103E] | 2784 |
| HUIL10[N101,L46K,R110P,LINKER[G1A]] | 2785 |
| HUIL10[N10K,L46K,L103E,LINKER[G1A]] | 2786 |
| HUIL10[N10Q,L46K,L103E,LINKER[G1A]] | 2787 |
| HUIL10[N10Q,L46K,L103E,LINKER[G1V]] | 2788 |
| HUIL10[N10Q,L46K,L103E,N116Q] | 2789 |
| HUIL10[N10Q,L46K,L103E] | 2790 |
| HUIL10[N10Q,L46K,R110P,LINKER[G1A]] | 2791 |

C-terminal IgG-cytokine fusions were expressed in CHO cells, purified, concentrated to 10 mg/mL, and assayed as described in Example 4.

N-terminal cytokine-IgG fusions were constructed by fusing IL-10M1 or engineered variants of IL-10M1 followed by a 10 amino acid linker with the sequence GGGSGGGS (SEQ ID NO:2676) to the N-terminus of the heavy chain of an anti-TREM-1 IgG1z SEFL2. Antibody-cytokine recombinant expression constructs were produced using Golden Gate cloning to assemble 1) synthetic DNA fragments comprising the antibody variable domains, 2) synthetic DNA fragments comprising the designed cytokine plus linker, 3) previously cloned "parts vectors" containing the necessary constant domains, and 4) a mammalian expression vector backbone. Fused heavy chains (HCs) were assembled into a vector backbone with a puromycin selection cassette and light chains (LCs) were assembled into a vector backbone with a hygromycin selection cassette. The constructs were ex-pressed in CHO cells, purified, concentrated to 10 mg/mL, and assayed as described in Example 4.

Buried Fab-cytokine-Fc molecules were constructed by fusing IL-10M1 or engineered variants of IL10M1, with a leading linker and a trailing linker of sequence GGGG (SEQ ID NO: 2677), into the hinge region of an anti-TREM-1 IgG1z SEFL2 antibody between the amino acids C282 and D283 (i.e., EPSKC-GGGG-IL10M1-GGGG-DKTHC (SEQ ID NO: 2724). Fab-cytokine-Fc recombinant expression constructs were produced using Golden Gate cloning to assemble 1) synthetic DNA fragments comprising the antibody variable domains, 2) synthetic DNA fragments comprising the designed cytokine plus linkers, 3) previously cloned "parts vectors" containing the necessary constant domains, and 4) a mammalian expression vector backbone. Fused heavy chains (HCs) were assembled into a vector backbone with a puromycin selection cassette and light chains (LCs) were assembled into a vector backbone with a hygromycin selection cassette. The constructs were expressed in CHO cells, purified, concentrated to 10 mg/mL, and assayed as described in Example 4.

TABLE 22

Deamidation Hot Spots in IL-10 Mutein-TREM-1 Antibody

| TREM1/IL-10 fusion Clone | Fusion location | Heavy chain SEQ ID NO: |
|---|---|---|
| TREM1_63F8.001_G4S_huIL10[N10Q,L46K,L103E,linker[G1V]] | C-terminal | 2726 |
| TREM1_63F8.001_G4S_huIL10[N10Q,L46K,L103E,linker[G1A]] | C-terminal | 2727 |
| TREM1_63F8.001_G4S_huIL10[N10K,L46K,L103E,linker[G1A]] | C-terminal | 2728 |
| TREM1_64D7.001_G4S_huIL10[N101,L46K,L103E,linker[G1A]] | C-terminal | 2729 |
| TREM1_64D7.001_G4S_huIL10[N10Q,L46K,L103E,linker[G1A]] | C-terminal | 2730 |
| TREM1_64D7.001_G4S_huIL10[N10Q,L46K,L103E,linker[G1V]] | C-terminal | 2731 |
| TREM1_64D7.001_G4S_huIL10[N10K,L46K,L103E,linker[G1A]] | C-terminal | 2732 |
| TREM1_63F8.001_G4S_huIL10[N10Q,L46K,R110P,linker[G1A]] | C-terminal | 2733 |
| TREM1_63F8.001_G4S_huIL10[L46K,R110P,linker[G1A]] | C-terminal | 2734 |
| TREM1_63F8.001_G4S_huIL10[N101,L46K,L103E,R110P,linker[G1A]] | C-terminal | 2735 |
| TREM1_63F8.001_G4S_huIl10[L46K,L103E,linker[G1V]] | C-terminal | 2736 |
| TREM1_63F8.001_G4S_huIl10[N101,L46K,R110P,linker[G1A]] | C-terminal | 2737 |
| TREM1_63F8.001_G4S_huIL10[L46K,L103E,linker[G1A]] | C-terminal | 2738 |
| TREM1_64D7.001_G4S_huIL10[N101,L46K,L103E,R110P,linker[G1A]] | C-terminal | 2739 |
| TREM1_64D7.001_G4S_huIL10[N10I,L46K,R110P,linker[G1A]] | C-terminal | 2740 |
| TREM1_64D7.001_G4S_huIL10[N10Q,L46K,R110P,linker[G1A]] | C-terminal | 2741 |
| TREM1_64D7.001_G4S_huIL10[L46K,L103E,linker[G1A]] | C-terminal | 2742 |
| TREM1_64D7.001_G4S_huIL10[L46K,L103E,linker[G1V]] | C-terminal | 2743 |

TABLE 22-continued

| | | |
|---|---|---|
| Deamidation Hot Spots in IL-10 Mutein-TREM-1 Antibody | | |
| TREM1/IL-10 fusion Clone | Fusion location | Heavy chain SEQ ID NO: |
| huIL10[L46K,L103E,linker[G1A]]_2xG4S_TREM1_63F8.001 | N-terminal | 2744 |
| huIL10[L46K,L103E,linker[G1A]]_2xG4S_TREM1_64D7.001 | N-terminal | 2745 |
| huIL10[L46K,L103E,linker[G1V]]_2xG4S_TREM1_63F8.001 | N-terminal | 2746 |
| huIL10[L46K,L103E,linker[G1V]]_2xG4S_TREM1_64D7.001 | N-terminal | 2747 |
| huIL10[N10I,L46K,L103E,linker[G1A]]_2xG4S_TREM1_63F8.001 | N-terminal | 2748 |
| huIL10[N10I,L46K,L103E,linker[G1A]]_2xG4S_TREM1_64D7.001 | N-terminal | 2749 |
| huIL10[N10I,L46K,L103E,linker[G1V]]_2xG4S_TREM1_63F8.001 | N-terminal | 2750 |
| huIL10[N10I,L46K,L103E,linker[G1V]]_2xG4S_TREM1_64D7.001 | N-terminal | 2751 |
| huIL10[N10Q,L46K,L103E,linker[G1A]]_2xG4S_TREM1_63F8.001 | N-terminal | 2752 |
| huIL10[N10Q,L46K,L103E,linker[G1A]]_2xG4S_TREM1_64D7.001 | N-terminal | 2753 |
| huIL10[N10Q,L46K,L103E,linker[G1V]]_2xG4S_TREM1_63F8.001 | N-terminal | 2754 |
| huIL10[N10Q,L46K,L103E,linker[G1V]]_2xG4S_TREM1_64D7.001 | N-terminal | 2755 |
| TREM1_63F8.001_Fab_huIL10[L46K,L103E,linker[G1A]]_Fc | Buried | 2756 |
| TREM1_63F8.001_Fab_huIL10[L46K,L103E,linker[G1V]]_Fc | Buried | 2757 |
| TREM1_63F8.001_Fab_huIL10[N10I,L46K,L103E,linker[G1A]]_Fc | Buried | 2758 |
| TREM1_63F8.001_Fab_huIL10[N10I,L46K,L103E,linker[G1V]]_Fc | Buried | 2759 |
| TREM1_63F8.001_Fab_huIL10[N10Q,L46K,L103E,linker[G1A]]_Fc | Buried | 2760 |
| TREM1_63F8.001_Fab_huIL10[N10Q,L46K,L103E,linker[G1V]]_Fc | Buried | 2761 |
| TREM1_63F8.001_G4S_huIL10[L46K,R110P] | C-terminal | 2762 |
| TREM1_63F8.001_G4S_huIL10[N10I,L46K,L103E,linker[G1A]] | C-terminal | 2763 |
| TREM1_63F8.001_G4S_huIL10[N10I,L46K,L103E] | C-terminal | 2764 |
| TREM1_63F8.001_G4S_huIL10[N10Q,L46K,L103E,N116Q] | C-terminal | 2765 |
| TREM1_63F8.001_G4S_huIL10[N10Q,L46K,L103E] | C-terminal | 2766 |
| TREM1_64D7.001_Fab_huIL10[L46K,L103E,linker[G1A]]_Fc | Buried | 2767 |
| TREM1_64D7.001_Fab_huIL10[L46K,L103E,linker[G1V]]_Fc | Buried | 2768 |
| TREM1_64D7.001_Fab_huIL10[N10I,L46K,L103E,linker[G1A]_Fc | Buried | 2769 |
| TREM1_64D7.001_Fab_huIL10[N10I,L46K,L103E,linker[G1V]]_Fc | Buried | 2770 |
| TREM1_64D7.001_Fab_huIL10[N10Q,L46K,L103E,linker[G1A]]_Fc | Buried | 2771 |
| TREM1_64D7.001_Fab_huIL10[N10Q,L46K,L103E,linker[G1V]]_Fc | Buried | 2772 |
| TREM1_64D7.001_G4S_huIL10[L46K,R110P,linker[G1A]] | C-terminal | 2773 |
| TREM1 64D7.001_G4S_huIL10[L46K,R110P] | C-terminal | 2774 |
| TREM1_64D7.001_G4S_huIL10[N10I,L46K,L103E] | C-terminal | 2775 |
| TREM1_64D7.001_G4S_huIL10[N10Q,L46K,L103E] | C-terminal | 2776 |

The heavy chains in Table 22 were paired with their respective light chain partners, e.g., SEQ ID NO: 976 or SEQ ID NO: 2554 for clone 63F8.001 (but lacking the signal sequence MDMRVPAQLLGLLLLWLRGARC (SEQ ID NO: 2674), and SEQ ID NO: 992 or SEQ ID NO: 2555 for 64D7.0F1 (but lacking the signal sequence MDMRVPAQLLGLLLLWLRGARC (SEQ ID NO:2674)). Several combinations of IL-101Mi mutations were identified that fixed deamidation sites and retained low aggregation after 10 days of stress at 40° C. at moderately high concentrations (10 mg/mL).

TABLE 23

Production and stability data for antigen binding proteins of engineered IL-10M1 muteins linked to anti-TREM1 antibodies 63F8 and 64D7

| Name | Titer (mg/L) | Final Yield (mg/L) | SEC pre-MP (%) | %HMW by SEC | purity MCE NR (%) | Delta % HMW (2 wk 40 C.) | Delta % Main Peak (2 wk 40 C.) |
|---|---|---|---|---|---|---|---|
| TREM1_63F8.001_G4S_HUIL10[N10Q,L46K,L103E,LINKER[G1V]] | 305 | 415 | 97 | 2.79 | 98 | 3.4 | 1.07 |
| TREM1_63F8.001_G4S_HUIL10[N10Q,L46K,L103E,LINKER[G1A]] | 325 | 430 | 96.8 | 2.94 | 97 | 3.4 | 0.96 |
| TREM1_63F8.001_G4S_HUIL10[N10K,L46K,L103E,LINKER[G1A]] | 303 | 405 | 96.3 | 3.32 | 97 | 3.8 | 1.32 |
| TREM1_64D7.001_G4S_HUIL10[N10I,L46K,L103E,LINKER[G1A]] | 315 | 339 | 99 | 0.89 | 98 | 7.2 | 0.75 |
| TREM1_64D7.001_G4S_HUIL10[N10Q,L46K,L103E,LINKER[G1A]] | 309 | 312 | 93.9 | 1.35 | 97 | 5 | 0.43 |
| TREM1_64D7.001_G4S_HUIL10[N10Q,L46K,L103E,LINKER[G1V]] | 331 | 318 | 98.6 | 1.33 | 97 | 10.2 | 0.51 |
| TREM1_64D7.001_G4S_HUIL10[N10K,L46K,L103E,LINKER[G1A]] | 285 | 295 | 97.6 | 2.17 | 96 | 11.1 | 0.66 |
| TREM1_63F8.001_G4S_HUIL10[N10Q,L46K,R110P,LINKER[G1A]] | 268 | 358 | 97.9 | 1.95 | 99 | 1.7 | 0.22 |
| TREM1_63F8.001_G4S_HUIL10[L46K,R110P,LINKER[G1A]] | 309 | 463 | 98 | 1.86 | 98 | 2.1 | 0.59 |
| TREM1_63F8.001_G4S_HUIL10[N10I,L46K,L103E,R110P,LINKER[G1A]] | 303 | 444 | 97.8 | 2.02 | 98 | 2.1 | 0.54 |
| TREM1_63F8.001_G4S_HUIL10[L46K,L103E,LINKER[G1V]] | 298 | 443 | 98.2 | 1.61 | 98 | 2.7 | 1.04 |
| TREM1_63F8.001_G4S_HUIL10[N10I,L46K,R110P,LINKER[G1A]] | 292 | 408 | 97.6 | 2.22 | 98 | 2.5 | 0.64 |
| TREM1_63F8.001_G4S_HUIL10[L46K,L103E,LINKER[G1A]] | 307 | 443 | 98.1 | 1.64 | 98 | 3.2 | 1.3 |
| TREM1_64D7.001_G4S_HUIL10[N10I,L46K,L103E,R110P,LINKER[G1A]] | 329 | 384 | 98.8 | 1.12 | 99 | 2.5 | -0.1 |
| TREM1_64D7.001_G4S_HUIL10[N10I,L46K,R110P,LINKER[G1A]] | 356 | 377 | 98.6 | 1.39 | 98 | 3 | 0.04 |
| TREM1_64D7.001_G4S_HUIL10[N10Q,L46K,R110P,LINKER[G1A]] | 232 | 242 | 98.9 | 1.01 | 99 | 3.6 | -0.03 |
| TREM1_64D7.001_G4S_HUIL10[L46K,L103E,LINKER[G1A]] | 341 | 370 | 98.6 | 1.26 | 98 | 9 | 0.33 |
| TREM1_64D7.001_G4S_HUIL10[L46K,L103E,LINKER[G1V]] | 321 | 363 | 98.6 | 1.26 | 98 | 9 | 0.4 |

Affinity of select fusion proteins for human TREM and cyno TREM1 were measured via BIACORE™ analysis (BIACORE™ T200, Sensor Chip: SCM5). BIACORE™ conditions include: Samples: 0.244 nM-500 nM range for IL10/TREM1 titration; Association: 3 minutes at 50 µl/min; Dissociation: 15 minutes for IL 10 and 30 minutes for TREM at 50I/min; Regeneration: 10 mM glycine, pH 1.5 at 30p/min for 30s (2x).

Affinity was measured against huIL10R alpha protein #274 from cells stably transfected Sf21 and huIL10R alpha protein #9100 expressed in human HEK293 cells. Results are shown in Table 24.

TABLE 24

| | | | | Rmax | Chi$^2$ | | |
|---|---|---|---|---|---|---|---|
| Sample | ka (1/Ms) | kd (1/s) | KD (M) | (RU) | (RU$^2$) | Ligand | Model |
| anti-huTREM1 61B12 G4S huIL10M1 Q38E IgG-protein | 4.78E+05 | 1.76E−02 | 3.68E−08 | 103.1 | 5.23 | huIL10R 274 | 1:1 Binding |
| anti-huTREM1 64D7 G4S huIL10M1 L46K IgG-protein | 2.92E+05 | 1.62E−02 | 5.55E−08 | 145.1 | 10 | huIL10R 274 | 1:1 Binding |
| anti-huTREM1 61B12 G4S huIL10M1 L46K IgG-protein | 3.42E+05 | 1.93E−02 | 5.63E−08 | 139.9 | 8.84 | huIL10R 274 | 1:1 Binding |
| anti-huTREM1 63F8 G4S huIL10M1 L46K IgG-protein | 3.21E+05 | 1.85E−02 | 5.78E−08 | 135.3 | 9.31 | huIL10R 274 | 1:1 Binding |
| anti-huTREM1 61B12 G4S huIL10M1 Q38E IgG-protein | 1.25E+05 | 2.09E−02 | 1.67E−07 | 103.5 | 1.83 | huIL 10R 9100 | 1:1 Binding |
| anti-huTREM1 61B12 G4S huIL10M1 L46K IgG-protein | 8.23E+04 | 1.86E−02 | 2.25E−07 | 121.7 | 2.16 | huIL 10R 9100 | 1:1 Binding |
| anti-huTREM1 64D7 G4S huIL10M1 L46K IgG-protein | 1.08E+05 | 2.61E−02 | 2.43E−07 | 124.1 | 2.35 | huIL 10R 9100 | 1:1 Binding |
| anti-huTREM1 63F8 G4S huIL10M1 L46K IgG-protein | 1.30E+05 | 3.16E−02 | 2.43E−07 | 119.7 | 2.35 | huIL10R 9100 | 1:1 Binding |
| anti-huTREM1 64D7 G4S huIL10M1 L46K IgG-protein | 3.18E+05 | 5.84E−05 | 1.84E−10 | 96.1 | 11 | huTREM1 ECD | 1:1 Binding |
| anti-huTREM1 63F8 G4S huIL10M1 L46K IgG-protein | 3.66E+05 | 7.92E−05 | 2.17E−10 | 133.7 | 16.3 | huTREM1 ECD | 1:1 Binding |
| anti-huTREM1 61B12 G4S huIL10M1 L46K IgG-protein | 1.69E+05 | 3.77E−05 | 2.23E−10 | 114.1 | 11.4 | huTREM1 ECD | 1:1 Binding |
| anti-huTREM1 61B12 G4S huIL10M1 Q38E IgG-protein | 1.63E+05 | 3.73E−05 | 2.29E−10 | 89.3 | 5.2 | huTREM1 ECD | 1:1 Binding |
| anti-huTREM1 64D7 G4S huIL10M1 L46K IgG-protein | 1.86E+05 | 1.59E−04 | 8.51E−10 | 91.8 | 18.02 | cyTREM1 ECD | 1:1 Binding |
| anti-huTREM1 61B12 G4S huIL10M1 Q38E IgG-protein | 1.78E+05 | 2.03E−04 | 1.14E−09 | 90.1 | 4.91 | cyTREM1 ECD | 1:1 Binding |
| anti-huTREM1 61B12 G4S huIL10M1 L46K IgG-protein | 1.78E+05 | 2.24E−04 | 1.25E−09 | 110.5 | 8.92 | cyTREM1 ECD | 1:1 Binding |
| anti-huTREM1 63F8 G4S huIL 10M1 L46K IgG-protein | 3.75E+05 | 5.26E−04 | 1.40E−09 | 133.6 | 10.6 | cyTREM1 ECD | 1:1 Binding |

HuTREM1 and cynoTREM1 show tight and stable binding with the select fusion molecules. Of the 2 huIL10R tested, huIL10R 274 showed stronger binding (10 fold difference) compared to the version 9100. IL10 R 274 was chosen for future testing.

Example 6—Efficacy of TREM-1 Antibodies Blocking Ligand Mediated Signaling in Human Peripheral Blood Mononuclear Cells (PBMC)

TREM-1 antibodies were tested for the ability to block signaling by inhibition of ligand binding to the TREM-1 receptor in human PBMCs. Frozen human PBMCs (IQ Biosciences) were thawed, washed and resuspended in complete cell culture media (RPMI/10% FBS/2 mM GlutaMax/1 mM Sodium Pyruvate/44 uM β-mercaptoethanol/1×DNAse I). PBMCs were seeded in 96 well cell culture plates at 100K/well and allowed to equilibrate for at least 30 minutes at 37° C. Thirteen anti-TREM-1 antibodies were diluted (3× serial dilution) in RPMI/10% FBS to generate final antibody concentrations ranging from 0.000017 nM to 3 nM. Antibody 57F5 was excluded from this analysis because in prior iterations of this assay that utilized higher concentrations of antibody, it failed to demonstrate any inhibition of signaling. Antibodies were pre-incubated with PBMCs for 30 minutes before addition of the TREM-1 ligand. Peptidoglycan recognition protein 1 (PGLYRP1) complexed with peptidoglycan (PGN) is one of several described TREM-1 ligands whose engagement with the TREM-1 receptor triggers the production of inflammatory cytokines (e.g. TNFα) and was used in these assays. To complex the proteins, human PGLYRP1 (R&D Systems) was combined with soluble PGN derived from *E. coli* (InvivoGen) in a 1.25:2 ratio and incubated for 45 minutes at 37° C. Complexed PGLYRP1/ PGN was added to PBMC/antibody and incubated overnight at 37° C. The following day, cell media was collected and assayed for TNFα by Human TNFα Alphalisa proximity assay (Perkin Elmer). Light emission at 615 nm was measured on an Envision 2103 multilabel plate reader. IC50 values were calculated using GraphPad Prism (v8.4.3) and are presented for two separate assays in Table 25 below.

TABLE 25

TREM-1 Antibody Inhibition of Ligand Mediated Signaling in Human PBMCs as Measured by TNFα Release

| Antibody ID | Ab IC50-Human PBMC (Trial 1) pM | Ab IC50-Human PBMC (Trial 2) pM |
|---|---|---|
| 57C10 | 8.8 | 7.2 |
| 30H2 | 6.9 | nd |
| 61B12 | 8.0 | nd |

TABLE 25-continued

TREM-1 Antibody Inhibition of Ligand Mediated Signaling in Human
PBMCs as Measured by TNFα Release

| Antibody ID | Ab IC50-Human PBMC (Trial 1) pM | Ab IC50-Human PBMC (Trial 2) pM |
|---|---|---|
| 61G5 | 10.2 | 2.7 |
| 63F8 | 3.8 | 3.1 |
| 64D7 | 4.3 | 2.4 |
| 34D1 | 10.0 | 6.9 |
| 44A5 | 3.5 | 6.1 |
| 46H7 | 6.3 | 4.4 |
| 49A2 | 3.1 | 3.3 |
| 66B8 | 31.6 | nd |
| 50A12 | 3.3 | 3.6 |
| 57F5 | nd | nd |
| 3E12 | no inhibition | nd |

These results show that the TREM-1 antibodies bind human TREM-1, and importantly demonstrate inhibition of ligand-induced TREM-1 activation in human primary cells (PBMCs).

Example 7-Efficacy of TREM-1 Antibodies Blocking Ligand Mediated Signaling in Cynomolgus Monkey Peripheral Blood Mononuclear Cells (PBMC)

TREM-1 antibodies were assayed for blocking signaling by the inhibition of ligand binding to the TREM-1 receptor in cynomolgus monkey PBMCs. Frozen cynomolgus monkey PBMCs (IQ Biosciences) were thawed, washed and resuspended in complete cell culture media (RPMI/10% FBS/2 mM GlutaMax/1 mM Sodium Pyruvate/44 uM β-mercaptoethanol/1×DNAse I). PBMCs were seeded in 96 well cell culture plates at 100K/well and allowed to equilibrate for at least 30 minutes at 37° C. Fourteen anti-TREM-1 antibodies were diluted (3× serial dilution) in RPMI/10% FBS to generate final antibody concentrations ranging from 0.00017 nM to 30 nM. Antibodies were pre-incubated with PBMCs for 30 minutes before addition of the TREM-1 ligand. Peptidoglycan recognition protein 1 (PGLYRP1) complexed with peptidoglycan (PGN) is one of several described TREM-1 ligands whose engagement with the TREM-1 receptor triggers the production of inflammatory cytokines (e.g. TNFα) and was used in this assay. To complex the proteins, cynomolgus monkey PGLYRP1 (Creative Biomart) was combined with soluble PGN derived from *E. coli* (InvivoGen) in a 1.25:2 ratio and incubated for 45 minutes at 37° C. Complexed PGLYRP1/PGN was added to PBMC/antibody and incubated overnight at 37° C. The following day, cell media was collected and assayed for TNFα by Cyno TNFα Alphalisa proximity assay (Perkin Elmer). Light emission at 615 nm was measured on an Envision 2103 multilabel plate reader. IC50 values were calculated using GraphPad Prism (v8.4.3) and are presented for two separate assays in Table 26.

TABLE 26

TREM-1 Antibody Inhibition of Ligand Mediated Signaling in Cyno
PBMCs as Measured by TNFα Release

| Antibody ID | Ab IC50-Cyno PBMC (Trial 1) pM | Ab IC50-Cyno PBMC (Trial 2) pM |
|---|---|---|
| 57C10 | 153.8 | 28.4 |
| 30H2 | 3768 | no inhibition |
| 61B12 | 46.9 | 17.4 |

TABLE 26-continued

TREM-1 Antibody Inhibition of Ligand Mediated Signaling in Cyno
PBMCs as Measured by TNFα Release

| Antibody ID | Ab IC50-Cyno PBMC (Trial 1) pM | Ab IC50-Cyno PBMC (Trial 2) pM |
|---|---|---|
| 61G5 | no inhibition | 2338 |
| 63F8 | 22.6 | 16.1 |
| 64D7 | 6939 | 780.5 |
| 34D1 | 100.1 | 16.2 |
| 44A5 | 57.9 | 9.1 |
| 46H7 | 95.1 | 9.7 |
| 49A2 | 731.5 | 265.7 |
| 66B8 | 113.9 | 23.2 |
| 50A12 | 2005 | nd |
| 57F5 | no inhibition | nd |
| 3E12 | no inhibition | no inhibition |

These results show that the TREM-1 antibodies bind cyno TREM-1, and importantly inhibit ligand-induced TREM-1 activation in cyno primary cells (PBMCs). Additionally, FIG. 6 illustrates TREM1 antibodies inhibition of PGLYRP1/PGN mediated TREM1 signaling in both cyno and human PBMCs.

Example 8-Efficacy of TREM-1 Fabs Blocking Spleen Tyrosine Kinase (SYK) Phosphorylation in a Human TREM-1/Dap12-HEK293 Overexpressing Cell Line TREM-1 Fabs were assayed for the ability to block signaling by the inhibition of ligand binding to the TREM-1 receptor in a cell line overexpressing human TREM-1/Dap12 and IC50s determined. Phosphorylation of Spleen Tyrosine Kinase (SYK) is an early step in the TREM-1 signaling cascade and in this assay is used as a measure of TREM-1 signaling. HEK293 cells that overexpress human TREM-1 and its obligate adaptor protein DNAX activation protein of 12 kDa (Dap12) were seeded in CellBIND plates (Corning) at 50K/well in complete media (DMEM/10% FBS) and allowed to attach overnight. Bivalent TREM-1 antibodies were unable to inhibit signaling in this system, likely due to a technical artefact of a high abundance of TREM-1 receptors in these cells and the ability of bivalent antibodies to crosslink them resulting in ligand-independent receptor agonism. Therefore, monovalent Fabs were used as surrogates for full antibodies in this assay. Fourteen anti-TREM-1 Fabs were diluted (3× serial dilution) in complete media to generate final antibody concentrations ranging from 0.00017 nM to 30 nM. Fabs were pre-incubated with TREM-1/Dap12-HEK293s for 30 minutes before addition of the TREM-1 ligand-complexed human PGLYRP1 (R&D Systems) and soluble PGN from *E. coli* (InvivoGen). To complex the PGLYRP1 and PGN, the proteins were combined in a 1:2 ratio and incubated at 37° C. for 45 minutes before adding to the cells/Fabs. Following a one hour room temperature incubation, the cells were lysed and the amount of phosphorylated SYK in the cell lysate was measured using the pSYK ALPHLISA® SUREFIRE® Ultra™ p-SYK (Tyr525/526) assay (Perkin Elmer). Light emission at 615 nm was measured on an Envision 2103 multilabel plate reader. IC50 values were calculated using GraphPad Prism (v8.4.3) and are presented for two separate assays as shown in Table 27.

TABLE 27

Antibody Inhibition of Ligand Mediated Signaling
in a Cell Line Overexpressing Human TREM-1/
DAP12 As Measured by SYK phosphorylation

| Fab ID | Fab IC50-pSYK Assay (Trial 1) pM | Fab IC50-pSYK Assay (Trial 2) pM |
|---|---|---|
| 57C10 Fab | 273.4 | 582.9 |
| 30H2 Fab | 467.2 | 374.5 |
| 61B12 Fab | 112.0 | 568.8 |
| 61G5 Fab | 387.0 | 186.4 |
| 63F8 Fab | 45.2 | 38.0 |
| 64D7 Fab | 229.1 | 70.0 |
| 34D1 Fab | 313.8 | 309.2 |
| 44A5 Fab | 188.9 | 325.0 |
| 46H7 Fab | 43.3 | 116.9 |
| 49A2 Fab | 1175 | 786.9 |
| 66B8 Fab | 4662 | nd |
| 50A12 Fab | 2850 | nd |
| 57F5 Fab | no inhibition | nd |
| 3E12 Fab | no inhibition | nd |

Figure 7:
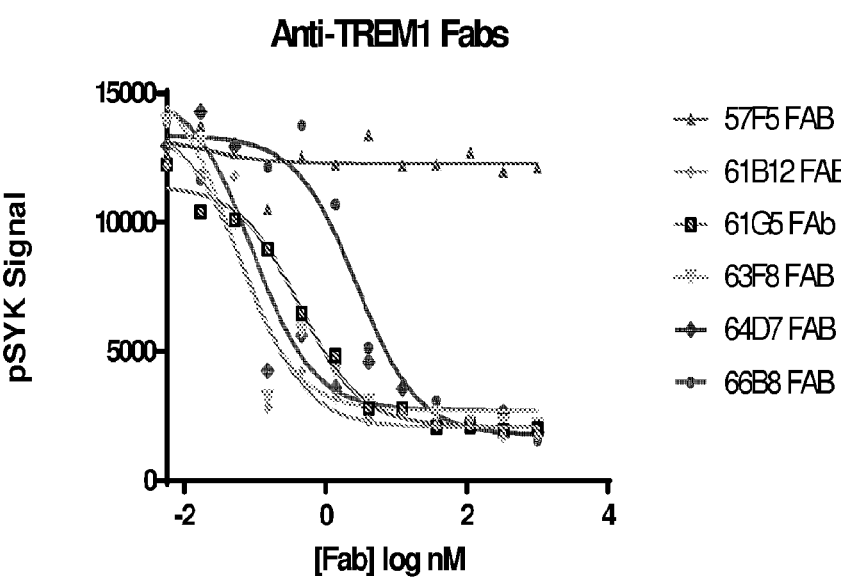
FIG. 7 shows inhibition by anti-human TREM-1 Fabs of ligand (PGLYRP1/PGN) mediated signaling in a cell line overexpressing human TREM-1/DAP12 as measured by phosphorylation of spleen tyrosine kinase (pSYK).

FIG. 7 is a graph showing that anti-TREM1 Fabs inhibit PGLYRP1/PGN-mediated SYK phosphorylation in TREM1/DAP12-HEK293 cells.

Any single embodiment herein may be supplemented with one or more element from any one or more other embodiment herein.

It is understood, therefore, that this invention is not limited to the particular embodiments disclosed, but is intended to cover all modifications which are within the spirit and scope of the invention as defined by the appended claims; the above description; the following numbered paragraphs, and/or shown in the attached drawings.

Examples of the Embodiments

Paragraph 1. A human interleukin-10 (IL-10) mutein comprising an amino acid sequence that is at least 90% identical to the amino acid sequence set forth in SEQ ID NO:2, wherein said IL-10 mutein has at least one mutation selected from a mutation in helical loop AB, helical loop CD, helical loop DE, helix A, helix B, helix C, helix D, helix E and/or helix F.

Paragraph 2. The IL-10 mutein of paragraph 1, comprising at least one mutation in helix A.

Paragraph 3. The IL-10 mutein of paragraph 1, comprising at least one mutation in helix F.

Paragraph 4. The IL-10 mutein of paragraph 1, comprising at least one mutation in helical loop AB.

Paragraph 5. The IL-10 mutein of any one of paragraphs 1 to 4, comprising a mutation in one or more of residues N10, H14, F15, P20, M22, L23, R24, R27, D28, K34, T35, Q38, M39, K40, D41, Q42, L43, D44, N45, L46, L47, L48, K49, F56, K57, Y59, L60, Q63, E67, Q70, M77, Q79, N82, Q83, D84, P85, D86, I87, A89, H90, S93, T100, L103, H109, R110, L112, E115, N116, A127, K130, I136, Y137, K138, S141, E142, D144, I145, E151, M154, M156, K157, or N160 of SEQ ID NO: 2 or an addition of 4 to 8 amino acids between helix D and helix E.

Paragraph 6. The IL-10 mutein of any one of paragraphs 1 to 5, wherein said mutein is at least 95% identical to the amino acid sequence set forth in SEQ ID NO: 2.

Paragraph 7. The IL-10 mutein of any one of paragraphs 1 to 6, wherein the mutation is one or more of N110, N10I, N10K, R27L, K34D, D41G, L46K, Q38E, Q38R, Q38D, K138L, K138D, I87A, H14Q, F15Y, M22V, K49T, K49S, F56Y, K57N, Y59T, L60Q, Q63E, Q63L, E67C, Q70E, Q70K, M77R, M77V, Q79R, Q79C, D84R, A89P, H90E, H90Q, S93E, S93Q, T100R, L103E, H109D, R110P, R110Q, L112V, E115K, N116D, N116Q, A127M, K130Q, I136C, Y137C, M154V, M156C, K157N, or N160D of SEQ ID NO: 2, optionally comprising addition of 6 amino acids between helix D and helix E.

Paragraph 8. The IL-10 mutein of any one of paragraphs 1 to 7, wherein the IL-10 mutein reduces the suppression of TNF-alpha production in monocytes, reduces levels of CD8+ T cell stimulation and/or reduces B cell stimulation in a human subject.

Paragraph 9. The IL-10 mutein of any one of paragraphs 5 to 7 wherein the amino acids between helix D and helix E are GGGSGG (SEQ ID NO: 2676).

Paragraph 10. The IL-10 mutein of any one of paragraphs 1 to 9 wherein the IL-10 mutein has the amino acid sequence set out in any one of SEQ ID NOs: 3-10 or SEQ ID NOS: 2138, 2140, 2142, 2144, 2146, 2148, 2150, 2152, 2154, 2156, 2158, 2160, 2162, 2164, 2166, 2168, 2170 2172, 2174, 2176, 2178, 2180, 2182, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2500, 2502, 2504, 2506, 2508, 2510, 2512, 2514, 2516, 2518, 2520, 2522, 2524, 2526, 2528, 2530, 2532, 2534, 2536, 2538, 2540, and 2777-2791.

Paragraph 11. A human interleukin-10 (IL-10) mutein comprising an amino acid sequence that is at least 90% identical to the amino acid sequence set forth in SEQ ID NO: 2, wherein said IL-10 mutein has at least one mutation in one or more of residues N10, H14, F15, P20, M22, L23, R24, R27, D28, K34, T35, Q38, M39, K40, D41, Q42, L43, D44, N45, L46, L47, L48, K49, F56, K57, Y59, L60, Q63, E67, Q70, M77, Q79, N82, Q83, D84, P85, D86,I87, A89, H90, S93, T100, L103, H109, R110, L112, E115, N116, A127, K130, I136, Y137, K138, S141, E142, D144, I145, E151, M154, M156, K157, or N160 of SEQ ID NO: 2.

Paragraph 12. The IL-10 mutein of any one of paragraphs 1 to 11, further comprising a half-life extending moiety.

Paragraph 13. The IL-10 mutein of paragraph 12 wherein the half-life extending moiety is an Fc domain.

Paragraph 14. The IL-10 mutein of paragraph 13 wherein the half-life extending moiety is polyethylene glycol (PEG).

Paragraph 15. The IL-10 mutein of any one of paragraphs 1-14, wherein the mutein is a dimer.

Paragraph 16. An isolated nucleic acid molecule comprising a nucleotide sequence that encodes the IL-10 mutein of any one of paragraphs 1 to 15.

Paragraph 17. An expression vector comprising the nucleic acid molecule of paragraph 16 operably linked to an expression control sequence.

Paragraph 18. A recombinant host cell comprising the nucleic acid of paragraph 16 or the vector of paragraph 17.

Paragraph 19. The host cell of paragraph 18, wherein the host cell is a mammalian cell.

Paragraph 20. The host cell of paragraph 18 or 19, wherein the host cell is a CHO cell.

Paragraph 21. A method of using the host cell of any one of paragraphs 18 to 20 to produce an IL-10 mutein, comprising culturing the host cell and recovering the IL-10 mutein.

Paragraph 22. An IL-10 mutein produced by the method of paragraph 21.

Paragraph 23. A pharmaceutical composition comprising the IL-10 mutein of any one of paragraphs 1-15 and a pharmaceutically acceptable carrier.

Paragraph 24. An isolated antigen binding protein, wherein the antigen binding protein:

a. is an antibody or antibody fragment;

b. binds to human TREM-1 having the amino acid sequence set forth in SEQ ID NO: 20;

c. comprises a light chain variable domain comprising:

i. a light chain CDR1 comprising an amino acid sequence selected from SEQ ID NOS: 30, 50, 70, 90, 110, 130, 150, 170, 190, 210, 230, 250, 270, 290 and 2190;

ii. a light chain CDR2 comprising an amino acid sequence selected from SEQ ID NOS: 31, 51, 71, 91, 111, 131, 151, 171, 191, 211, 231, 251, 271, 291 and 2191;

iii. a light chain CDR3 comprising an amino acid sequence selected from SEQ ID NOS: 32, 52, 72, 92, 112, 132, 152, 172, 192, 212, 232, 252, 272, 292 and 2192; and d. comprises a heavy chain variable domain comprising:

i. a heavy chain CDR1 comprising an amino acid sequence selected from SEQ ID NOS: 36, 56, 76, 96, 116, 136, 156, 176, 196, 216, 236, 256, 276, 296 and 2196;

ii. a heavy chain CDR2 comprising an amino acid sequence selected from SEQ ID NOS: 37, 57, 77, 97, 117, 137, 157, 177, 197, 217, 237, 257, 277, 297 and 2197; and iii. a heavy chain CDR3 comprising an amino acid sequence selected from SEQ ID NOS: 38, 58, 78, 98, 118, 138, 158, 178, 198, 218, 238, 258, 278, 298 and 2198.

Paragraph 25. The antigen binding protein of paragraph 24, wherein:

a. the light chain CDR1 sequence is set out in SEQ ID NO: 30, 50, 70, 110, 150, 170, or 290;

b. the light chain CDR2 sequence is set out in SEQ ID NOS: 31, 51, 71, 111, 151, 171, or 291;

c. the light chain CDR3 sequence is set out in SEQ ID NO 32, 52, 72, 112, 152, 172, or 292;

d. the heavy chain CDR1 sequence is set out in SEQ ID NO: 36, 56, 76, 116, 156, 176, and 296;

e. the heavy chain CDR2 sequence is set out in SEQ ID NO: 37, 57, 77, 117, 157, 177, and 297; and f. the heavy chain CDR3 sequence is set out in SEQ ID NO: 38, 58, 78, 118, 158, and 298.

Paragraph 26. The antigen binding protein of paragraph 24 or 25, wherein:

a. the light chain CDR1 sequence is set out in SEQ ID NO: 50 or 110;

b. the light chain CDR2 sequence is set out in SEQ ID NO: 51 or 111;

c. the light chain CDR3 sequence is set out in SEQ ID NO: 52 or 112;

d. the heavy chain CDR1 sequence is set out in SEQ ID NO: 56 or 116;

e. the heavy chain CDR2 sequence is set out in SEQ ID NO: 57 or 117; and f. the heavy chain CDR3 sequence is set out in SEQ ID NOS: 58 or 118

Paragraph 27. The antigen-binding protein of paragraphs 24 to 26 comprising a set of CDR amino acid sequences selected from:

i) SEQ ID NO: 30 (LCDR1), SEQ ID NO: 31 (LCDR2), SEQ ID NO: 32 (LCDR3), SEQ ID NO: 36 (HCDR1), SEQ ID NO: 37 (HCDR2) and SEQ ID NO: 38 (HCDR3);

ii) SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3);

iii) SEQ ID NO: 70 (LCDR1), SEQ ID NO: 71 (LCDR2), SEQ ID NO: 72 (LCDR3), SEQ ID NO: 76 (HCDR1), SEQ ID NO: 77 (HCDR2) and SEQ ID NO: 78 (HCDR3);

iv) SEQ ID NO: 90 (LCDR1), SEQ ID NO: 91 (LCDR2), SEQ ID NO: 92 (LCDR3), SEQ ID NO: 96 (HCDR1), SEQ ID NO: 97 (HCDR2) and SEQ ID NO: 98 (HCDR3);

v) SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) and SEQ ID NO: 118 (HCDR3);

vi) SEQ ID NO: 130 (LCDR1), SEQ ID NO: 131 (LCDR2), SEQ ID NO: 132 (LCDR3), SEQ ID NO: 136 (HCDR1), SEQ ID NO: 137 (HCDR2) and SEQ ID NO: 138 (HCDR3);

vii) SEQ ID NO: 150 (LCDR1), SEQ ID NO: 151 (LCDR2), SEQ ID NO: 152 (LCDR3), SEQ ID NO: 156 (HCDR1), SEQ ID NO: 157 (HCDR2) and SEQ ID NO: 158 (HCDR3);

viii) SEQ ID NO: 170 (LCDR1), SEQ ID NO: 171 (LCDR2), SEQ ID NO: 172 (LCDR3), SEQ ID NO: 176 (HCDR1), SEQ ID NO: 177 (HCDR2) and SEQ ID NO: 178 (HCDR3);

ix) SEQ ID NO: 190 (LCDR1), SEQ ID NO: 191 (LCDR2), SEQ ID NO: 192 (LCDR3), SEQ ID NO: 196 (HCDR1), SEQ ID NO: 197 (HCDR2) and SEQ ID NO: 198 (HCDR3);

x) SEQ ID NO: 210 (LCDR1), SEQ ID NO: 211 (LCDR2), SEQ ID NO: 212 (LCDR3), SEQ ID NO: 216 (HCDR1), SEQ ID NO: 217 (HCDR2) and SEQ ID NO: 218 (HCDR3);

xi) SEQ ID NO: 230 (LCDR1), SEQ ID NO: 231 (LCDR2), SEQ ID NO: 232 (LCDR3), SEQ ID NO: 236 (HCDR1), SEQ ID NO: 237 (HCDR2) and SEQ ID NO: 238 (HCDR3);

xii) SEQ ID NO: 250 (LCDR1), SEQ ID NO: 251 (LCDR2), SEQ ID NO: 252 (LCDR3), SEQ ID NO: 256 (HCDR1), SEQ ID NO: 257 (HCDR2) and SEQ ID NO: 258 (HCDR3);

xiii) SEQ ID NO: 270 (LCDR1), SEQ ID NO: 271 (LCDR2), SEQ ID NO: 272 (LCDR3), SEQ ID NO: 276 (HCDR1), SEQ ID NO: 277 (HCDR2) and SEQ ID NO: 278 (HCDR3);

xiv) SEQ ID NO: 290 (LCDR1), SEQ ID NO: 291 (LCDR2), SEQ ID NO: 292 (LCDR3), SEQ ID NO: 296 (HCDR1), SEQ ID NO: 297 (HCDR2) and SEQ ID NO: 298 (HCDR3); or xv) SEQ ID NO: 2190 (LCDR1), SEQ ID NO: 2191 (LCDR2), SEQ ID NO: 2192 (LCDR3), SEQ ID NO: 2196 (HCDR1), SEQ ID NO: 2197 (HCDR2) and SEQ ID NO: 2198 (HCDR3).

Paragraph 28. The antigen-binding protein of any one of paragraphs 24 to 27 comprising a set of CDR amino acid sequences selected from:

i) SEQ ID NO: 30 (LCDR1), SEQ ID NO: 31 (LCDR2), SEQ ID NO: 32 (LCDR3), SEQ ID NO: 36 (HCDR1), SEQ ID NO: 37 (HCDR2) and SEQ ID NO: 38 (HCDR3);

ii) SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3);

iii) SEQ ID NO: 70 (LCDR1), SEQ ID NO: 71 (LCDR2), SEQ ID NO: 72 (LCDR3), SEQ ID NO: 76 (HCDR1), SEQ ID NO: 77 (HCDR2) and SEQ ID NO: 78 (HCDR3);

iv) SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) and SEQ ID NO: 118 (HCDR3);

v) SEQ ID NO: 150 (LCDR1), SEQ ID NO: 151 (LCDR2), SEQ ID NO: 152 (LCDR3), SEQ ID NO: 156 (HCDR1), SEQ ID NO: 157 (HCDR2) and SEQ ID NO: 158 (HCDR3);

vi) SEQ ID NO: 170 (LCDR1), SEQ ID NO: 171 (LCDR2), SEQ ID NO: 172 (LCDR3), SEQ ID NO: 176 (HCDR1), SEQ ID NO: 177 (HCDR2) and SEQ ID NO: 178 (HCDR3); or vii) SEQ ID NO: 290 (LCDR1), SEQ ID NO: 291 (LCDR2), SEQ ID NO: 292 (LCDR3), SEQ ID NO: 296 (HCDR1), SEQ ID NO: 297 (HCDR2) and SEQ ID NO: 298 (HCDR3).

Paragraph 29. The antigen-binding protein of any one of paragraphs 24 to 28 comprising a set of CDR amino acid sequences selected from SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3); and SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) and SEQ ID NO: 118 (HCDR3).

Paragraph 30. The antigen-binding protein of any one of paragraphs 24 to 29 comprising:

a. a light chain variable domain comprising an amino acid sequence selected from the group consisting of:

i. a sequence at least 80% identical to an amino acid sequence selected from SEQ ID NOS: 41, 61, 81, 101, 121, 141, 161, 181, 201, 221, 241, 261, 281, 301 and 2185;

ii. a sequence encoded by a polynucleotide sequence that is at least 80% identical to an amino acid sequence selected from SEQ ID NOS: 41, 61, 81, 101, 121, 141, 161, 181, 201, 221, 241, 261, 281, 301 and 2185; or iii. a sequence encoded by a polynucleotide that hybridizes under moderately stringent conditions to the complement of a polynucleotide consisting of a nucleic acid sequence selected from SEQ ID NOS: 39, 59, 79, 99, 119, 139, 159, 179, 199, 219, 239, 259, 279, 299 and 2183; and b. a heavy chain variable domain comprising an amino acid sequence selected from the group consisting of:

i. a sequence that is at least 80% identical to an amino acid sequence selected from SEQ ID NOS: 42, 62, 82, 102. 122, 142, 162, 182, 202, 222, 242, 262, 282, 302 and 2186;

ii. a sequence encoded by a polynucleotide sequence that is at least 80% identical to an amino acid sequence selected from SEQ ID NOS: 42, 62, 82, 102. 122, 142, 162, 182, 202, 222, 242, 262, 282, 302 and 2186; or iii. a sequence encoded by a polynucleotide that hybridizes under moderately stringent conditions to the complement of a polynucleotide consisting of a nucleic sequence selected from SEQ ID NOS: 40, 60, 80, 100, 120, 140, 160, 180, 200, 220, 240, 260, 280, 300 and 2184.

Paragraph 31. The antigen-binding protein of any one of paragraphs 24 to 30 wherein the antigen binding protein comprises an amino acid sequence at least 90% identical to a heavy chain variable region amino acid sequence selected from the group consisting of SEQ ID NOS: 42, 62, 82, 102, 122, 142, 162, 182, 202, 222, 242, 262, 282, 302 and 2186.

Paragraph 32. The antigen-binding protein of any one of paragraphs 24 to 31 wherein the antigen binding protein comprises an amino acid sequence at least 90% identical to a heavy chain variable region amino acid sequence selected from the group consisting of SEQ ID NOs: 42, 62, 82, 122, 162, 182, and 302.

Paragraph 33. The antigen-binding protein of any one of paragraphs 24 to 32 wherein the antigen binding protein comprises an amino acid sequence at least 90% identical to a heavy chain variable region amino acid sequence selected from the group consisting of SEQ ID NOs: 62 and 122.

Paragraph 34. The antigen-binding protein of any of paragraphs 24 to 33, wherein the antigen-binding protein comprises an amino acid sequence at least 90% identical to a light chain variable region amino acid sequence selected from the group consisting of SEQ ID NOS: 41, 61, 81, 101, 121, 141, 161, 181, 201, 221, 241, 261, 281, 301 and 2185.

Paragraph 35. The antigen-binding protein of any one of paragraphs 24 to 34 wherein the antigen binding protein comprises an amino acid sequence at least 90% identical to a light chain variable region amino acid sequence selected from the group consisting of SEQ ID NOS: 41, 61, 81, 121, 161, 181, and 301.

Paragraph 36. The antigen-binding protein of any one of paragraphs 24 to 35 wherein the antigen binding protein comprises an amino acid sequence at least 90% identical to a light chain variable region amino acid sequence selected from the group consisting of SEQ ID NOS: 61 and 121.

Paragraph 37. The antigen binding protein of any one of paragraphs 24 to 36 comprising:

i) a light chain variable domain set out in SEQ ID NO: 41 and a heavy chain variable domain set out in SEQ ID NO: 42;

ii) a light chain variable domain set out in SEQ ID NO: 61 and a heavy chain variable domain set out in SEQ ID NO: 62;

iii) a light chain variable domain set out in SEQ ID NO: 81 and a heavy chain variable domain set out in SEQ ID NO: 82;

iv) a light chain variable domain set out in SEQ ID NO: 101 and a heavy chain variable domain set out in SEQ ID NO: 102;

v) a light chain variable domain set out in SEQ ID NO: 121 and a heavy chain variable domain set out in SEQ ID NO: 122;

vi) a light chain variable domain set out in SEQ ID NO: 141 and a heavy chain variable domain set out in SEQ ID NO: 142;

vii) a light chain variable domain set out in SEQ ID NO: 161 and a heavy chain variable domain set out in SEQ ID NO: 162;

viii) a light chain variable domain set out in SEQ ID NO: 181 and a heavy chain variable domain set out in SEQ ID NO: 182;

ix) a light chain variable domain set out in SEQ ID NO: 201 and a heavy chain variable domain set out in SEQ ID NO: 202;

x) a light chain variable domain set out in SEQ ID NO: 221 and a heavy chain variable domain set out in SEQ ID NO: 222;

xi) a light chain variable domain set out in SEQ ID NO: 241 and a heavy chain variable domain set out in SEQ ID NO: 242;

xii) a light chain variable domain set out in SEQ ID NO: 261 and a heavy chain variable domain set out in SEQ ID NO: 262;

xiii) a light chain variable domain set out in SEQ ID NO: 281 and a heavy chain variable domain set out in SEQ ID NO: 282;

xiv) a light chain variable domain set out in SEQ ID NO: 301 and a heavy chain variable domain set out in SEQ ID NO: 302; or xv) a light chain variable domain set out in SEQ ID NO: 2185 and a heavy chain variable domain set out in SEQ ID NO: 2186.

Paragraph 38. The antigen binding protein of any one of paragraphs 24 to 37 comprising:

i) a light chain variable domain set out in SEQ ID NO: 41 and a heavy chain variable domain set out in SEQ ID NO: 42;

ii) a light chain variable domain set out in SEQ ID NO: 61 and a heavy chain variable domain set out in SEQ ID NO: 62;

iii) a light chain variable domain set out in SEQ ID NO: 81 and a heavy chain variable domain set out in SEQ ID NO: 82;

iv) a light chain variable domain set out in SEQ ID NO: 121 and a heavy chain variable domain set out in SEQ ID NO: 122;

v) a light chain variable domain set out in SEQ ID NO: 161 and a heavy chain variable domain set out in SEQ ID NO: 162;

vi) a light chain variable domain set out in SEQ ID NO: 181 and a heavy chain variable domain set out in SEQ ID NO: 182; or vii) a light chain variable domain set out in SEQ ID NO: 301 and a heavy chain variable domain set out in SEQ ID NO: 302.

Paragraph 39. The antigen binding protein of any one of paragraphs 24 to 38 comprising: a light chain variable domain set out in SEQ ID NO: 61 and a heavy chain variable domain set out in SEQ ID NO: 62; or a light chain variable domain set out in SEQ ID NO: 121 and a heavy chain variable domain set out in SEQ ID NO: 122.

Paragraph 40. The antigen-binding protein of any of paragraphs 24 to 39 wherein one or more heavy chain framework amino acids of the anti-antigen-binding protein are replaced with corresponding amino acid(s) from another human antibody amino acid sequence.

Paragraph 41. The antigen-binding protein of any one of paragraphs 24 to 40 wherein one or more light chain framework amino acids of the antigen-binding protein are replaced with corresponding amino acid(s) from another human antibody amino acid sequence.

Paragraph 42. The antigen-binding protein of any one of paragraphs 24 to 41, wherein the heavy chain comprises a constant region selected from heavy chain constant regions of an IgG, IgM, IgA, IgD, IgE, fragments thereof, combinations thereof, and modifications thereof in which one to ten heavy chain framework amino acids are replaced with corresponding amino acid(s) from another human antibody amino acid sequence.

Paragraph 43. An antigen binding protein that competes for binding to human TREM-1 having the sequence of SEQ ID NO: 20 with an antigen binding protein of any one of paragraphs 24 to 42.

Paragraph 44. The antigen-binding protein of any one of paragraphs 24 to 43, wherein the antigen-binding protein is selected from the group consisting of a human antibody, a humanized antibody, a chimeric antibody, a monoclonal antibody, a recombinant antibody, a Fab, a F(ab')2, a Fab2, a monovalent IgG, an scFv, an scFv-Fc, an IgG1 antibody, an IgG2 antibody, an IgG3 antibody, and an IgG4 antibody.

Paragraph 45. The antigen-binding protein of paragraph 44 wherein the antigen-binding protein is an IgG1 antibody.

Paragraph 46. The antigen-binding protein of paragraph 44 or 45 wherein the antigen-binding protein is a monovalent IgG.

Paragraph 47. The antigen-binding protein of any one of paragraphs 44 to 46 wherein the antigen-binding protein is a human antibody.

Paragraph 48. The antigen-binding protein of any one of paragraphs 24 to 47 comprising a heavy chain amino acid sequence at least 90% identical to a sequence selected from SEQ ID NOS: 42, 62, 82, 102. 122, 142, 162, 182, 202, 222, 242, 262, 282, 302 and 2186 and a light chain amino acid sequence at least 90% identical to a sequence selected from SEQ ID NOS: 41, 61, 81, 101, 121, 141, 161, 181, 201, 221, 241, 261, 281, 301 and 2185.

Paragraph 49. The antigen-binding protein of any one of paragraphs 24 to 48 having a heavy chain amino acid selected from SEQ ID NOS: 42, 62, 82, 102. 122, 142, 162, 182, 202, 222, 242, 262, 282, 302, and 2186 and a light chain amino acid sequence selected from SEQ ID NOS: 41, 61, 81, 101, 121, 141, 161, 181, 201, 221, 241, 261, 281, 301 and 2185.

Paragraph 50. The antigen-binding protein of any one of paragraphs 24 to 49 having a heavy chain amino acid selected from SEQ ID NOS: 42, 62, 82, 122, 162, 182, and 302.

Paragraph 51. The antigen-binding protein of any one of paragraphs 24 to 50 having a heavy chain amino acid selected from SEQ ID NOS: 62 and 122.

Paragraph 52. The antigen-binding protein of any one of paragraphs 24 to 51 having a light chain amino acid selected from SEQ ID NOS: 41, 61, 81, 121, 161, 181, and 301.

Paragraph 53. The antigen-binding protein of any one of paragraphs 24 to 52 having a light chain amino acid selected from SEQ ID NOS: 61 and 121.

Paragraph 54. An isolated nucleic acid molecule comprising a nucleotide sequence that encodes the heavy chain of any one of paragraphs 24 to 53.

Paragraph 55. An isolated nucleic acid molecule comprising a nucleotide sequence that encodes the light chain of any one of paragraphs 24 to 53.

Paragraph 56. The nucleic acid molecule of paragraph 54, further comprising a nucleotide sequence that encodes the light chain of any one of paragraphs 24 to 53.

Paragraph 57. The nucleic acid molecule of any one of paragraphs 54 to 56 wherein the nucleotide sequence encoding the light chain variable region is set out in SEQ ID NOS: 39, 59, 79, 99, 119, 139, 159, 179, 199, 219, 239, 259, 279, 299 and 2183 and the nucleotide sequence encoding the heavy chain variable region set out in SEQ ID NOS: 40, 60, 80, 100, 120, 140, 160, 180, 200, 220, 240, 260, 280, 300 and 2184.

Paragraph 58. An expression vector comprising the nucleic acid molecule of any one of paragraphs 54 to 57 operably linked to an expression control sequence.

Paragraph 59. A recombinant host cell comprising the nucleic acid molecule of paragraph 54; or the nucleic acid molecule of paragraph 55; or the nucleic acid molecule of paragraph 54 and the nucleic molecule of paragraph 55; or the nucleic acid molecule of paragraph 56 or 57; or the vector of paragraph 58.

Paragraph 60. The host cell of paragraph 59, wherein the host cell is a mammalian cell.

Paragraph 61. The host cell of paragraph 59 or 60 wherein the host cell is a CHO cell.

Paragraph 62. A method of using the host cell of any of paragraphs 59 to 61 to produce an antigen-binding protein, comprising culturing the host cell and recovering said antigen-binding protein.

Paragraph 63. An antigen-binding protein produced by the method of paragraph 62.

Paragraph 64. A pharmaceutical composition comprising the antibody of any one of paragraphs 24-53 and a pharmaceutically acceptable carrier.

Paragraph 65. An antigen binding protein comprising an antigen-binding moiety and one or two IL-10 moieties wherein:
  a. the antigen-binding moiety is an antibody or antibody fragment,
  b. each IL-10 moiety is independently monovalent or bivalent,
  c. each IL-10 moiety is independently selected from and one or more human IL-10 muteins having sequences that are 90% identical to SEQ ID NO: 1, and
  d. at least one IL-10 moiety is covalently bound to the antigen-binding moiety.

Paragraph 66. The antigen binding protein of paragraph 65 wherein at least one IL-10 moiety is fused to a C-terminus of the antigen-binding moiety.

Paragraph 67. An antigen binding protein comprising:
  (a) a polypeptide sequence having the formula A-L-M or M-L-A, wherein
    i) A is an immunoglobulin heavy chain of an IgG antibody that binds to a TREM-1 protein set out in SEQ ID NO: 20,
    ii) L is a linker peptide comprising from 4 to 20 amino acids and
    iii) M is a mutein of IL-10 having at least 90% sequence identity to wt IL-10 set out in SEQ ID NO: 2; and
  (b) an immunoglobulin light chain of an IgG antibody that binds TREM-1 protein set out in SEQ ID NO: 20,
  wherein the immunoglobulin heavy chain of (a) and the immunoglobulin light chain of (b) form an IgG antibody moiety that binds TREM-1, wherein the protein comprises one or two molecules of the polypeptide of (a) and one or two molecules of the light chain of (b), optionally wherein only 1 polypeptide of (a) comprises an M moiety.

Paragraph 68. The antigen binding protein of any one of paragraphs 65 to 67, wherein:
  a. the antigen-binding moiety is an antibody, and
  b. an IL-10 moiety is fused to each heavy chain of the antibody.

Paragraph 69. The antigen binding protein of any one of paragraphs 65 to 68 wherein each IL-10 moiety is a monomer.

Paragraph 70. The antigen binding protein of any one of paragraphs 65 to 69 wherein:
  a. each IL-10 moiety comprises an amino acid sequence that is at least 90% identical to the amino acid sequence set forth in SEQ ID NO: 2, and b. each IL-10 moiety independently comprises at least one mutation selected from a mutation in helical loop AB, helical loop CD, helical loop DE, helix A, helix B, helix C, helix D, helix E and/or helix F.

Paragraph 71. The antigen binding protein of paragraph 70, wherein at least one IL-10 moiety comprises at least one mutation in helix A.

Paragraph 72. The antigen binding protein of paragraph 70, wherein at least one IL-10 moiety comprises at least one mutation in helix F.

Paragraph 73. The antigen binding protein of [paragraph 70, wherein at least one IL-10 moiety comprises at least one mutation in helical loop AB.

Paragraph 74. The antigen binding protein of any one of paragraphs 65 to 73, wherein the antigen binding protein suppresses TNF-α production in myeloid cells.

Paragraph 75. The antigen binding protein of any one of paragraphs 65 to 74 wherein, the IL-10 mutein antigen binding protein suppresses TNF-α production in myeloid cells, but still lacks CD8+ T cell and B cell activation.

Paragraph 76. The antigen binding protein of any one of paragraphs 65 to 75, wherein each IL-10 moiety independently comprises a mutation in one or more of residues N10, H14, F15, P20, M22, L23, R24, R27, D28, K34, T35, Q38, M39, K40, D41, Q42, L43, D44, N45, L46, L47, L48, K49, F56, K57, Y59, L60, Q63, E67, Q70, M77, Q79, N82, Q83, D84, P85, D86, I87, A89, H90, S93, T100, L103, H109, R110, L112, E115, N116, A127, K130, I136, Y137, K138, S141, E142, D144, I145, E151, M154, M156, K157, or N160 of SEQ ID NO: 2 or an addition of 4-8 amino acids between helix D and helix E.

Paragraph 77. The antigen binding protein of any one of paragraphs 65 to 76, wherein each IL-10 moiety is at least 95% identical to the amino acid sequence set forth in SEQ ID NO: 2.

Paragraph 78. The antigen binding protein of any one of paragraphs 65 to 77, wherein each IL-10 moiety independently comprises one or more mutations selected from the group consisting of N10Q, N101, N10K, R27L, K34D, D41G, L46K, Q38E, Q38R, Q38D, K138L, K138D, I87A, H14Q, F15Y, M22V, K49T, K49S, F56Y, K57N, Y59T, L60Q, Q63E, Q63L, E67C, Q70E, Q70K, M77R, M77V, Q79R, 079C, D84R, A89P, H90E, H90Q, S93E, S93Q, T100N, L103E, H109D, R110P, R110Q, L112V, E115K, N116D, N116Q, A127M, K130Q, I136C, Y137C, M154V, M156C, K157N, or N160D of SEQ ID NO: 2, optionally comprising an addition of six amino acids between helix D and helix E.

Paragraph 79. The antigen binding protein of any one of paragraphs 76 to 78 wherein the amino acids between helix D and helix E are GGGSGG (SEQ ID NO: 2676).

Paragraph 80. The antigen binding protein of an one of paragraphs 65 to 79 wherein the IL-10 moiety has the amino acid sequence set out in any one of SEQ ID NOS: 3-10 or SEQ ID NOS: 2138, 2140, 2142, 2144, 2146, 2148, 2150, 2152, 2154, 2156, 2158, 2160, 2162, 2164, 2166, 2168, 2170 2172, 2174, 2176, 2178, 2180, 2182, 2360, 2362, 2364, 2366, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2500, 2502, 2504, 2506, 2508, 2510, 2512, 2514, 2516, 2518, 2520, 2522, 2524, 2526, 2528, 2530, 2532, 2534, 2536, 2538, 2540, and 2777-2791.

Paragraph 81. The antigen binding protein of any one of paragraphs 65 to 80 wherein:

a. the antigen binding protein comprises at least one linker fused to at least one C-terminus of the antigen-binding moiety and b. an IL-10 moiety is covalently bound to the C-terminus of each linker.

Paragraph 82. The antigen binding protein of paragraph 81 wherein the linker is between 4 and 18 amino acids long.

Paragraph 83. The antigen binding protein of paragraph 81 or 82, wherein the linker is six amino acids long.

Paragraph 84. The antigen binding protein of any one of paragraphs 65 to 83 further comprising a human heavy chain constant region attached to said heavy chain variable region.

Paragraph 85. The antigen binding protein of any one of paragraphs 65 to 84 further comprising a human light chain constant region attached to said light chain variable region.

Paragraph 86. The antigen binding protein of any one of paragraphs 65 to 85 that has the heavy chain amino acid sequence set out in any one of SEQ ID NOS: 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1Q83, and 1085.

Paragraph 87. The antigen binding protein of any one of paragraphs 65 to 86 that has a light chain amino acid sequence set out in any one of SEQ ID NOS: 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, and 1086.

Paragraph 88. The antigen binding protein of any one of paragraphs 65 to 87 that has a heavy chain amino acid sequence set out in any one of SEQ ID NOS: 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1Q83, and 1085 and a corresponding light chain amino acid sequence set out in SEQ ID NOS: 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, and 1086.

Paragraph 89. The antigen binding protein of any one of paragraphs 65 to 85 that has a heavy chain amino acid sequence set out in any one of SEQ ID NOS: 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, and 2007.

Paragraph 90. The antigen binding protein of any one of paragraphs 65 to 85 or 89 that has a light chain amino acid sequence set out in any one of SEQ ID NOS: 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, and 2605.

Paragraph 91. The antigen binding protein of any one of paragraphs 65 to 85 or 88 to 90 that has a heavy chain amino acid sequence set out in any one of SEQ ID NOS: 1883, 1885, 1887, 1889, 1891, 1893, 1895, 1897, 1899, 1901, 1903, 1905, 1907, 1909, 1911, 1913, 1915, 1917, 1919, 1921, 1923, 1925, 1927, 1929, 1931, 1933, 1935, 1937, 1939, 1941, 1943, 1945, 1947, 1949, 1951, 1953, 1955, 1957, 1959, 1961, 1963, 1965, 1967, 1969, 1971, 1973, 1975, 1977, 1979, 1981, 1983, 1985, 1987, 1989, 1991, 1993, 1995, 1997, 1999, 2001, 2003, 2005, and 2007, and a corresponding light chain amino acid sequence set out in SEQ ID NOS: 2543, 2544, 2545, 2546, 2547, 2548, 2549, 2550, 2551, 2552, 2553, 2554, 2555, 2556, 2557, 2558, 2559, 2560, 2561, 2562, 2563, 2564, 2565, 2566, 2567, 2568, 2569, 2570, 2571, 2572, 2573, 2574, 2575, 2576, 2577, 2578, 2579, 2580, 2581, 2582, 2583, 2584, 2585, 2586, 2587, 2588, 2589, 2590, 2591, 2592, 2593, 2594, 2595, 2596, 2597, 2598, 2599, 2600, 2601, 2602, 2603, 2604, and 2605.

Paragraph 92. The antigen binding protein of any one of paragraphs 65 to 85 that has a heavy chain amino acid sequence set out in any one of SEQ ID NOS: 2011, 2013, 2015, 2017, 2019, 2021, 2026, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, and 2135.

Paragraph 93. The antigen binding protein of any one of paragraphs 65 to 85 or 92 that has a light chain amino acid sequence set out in any one of SEQ ID NOS: 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, and 2357.

Paragraph 94. The antigen binding protein of any one of paragraphs 65 to 85 or 92 to 93 that has a heavy chain amino acid sequence set out in any one of SEQ ID NOS: 2011, 2013, 2015, 2017, 2019, 2021, 2026, 2025, 2027, 2029, 2031, 2033, 2035, 2037, 2039, 2041, 2043, 2045, 2047, 2049, 2051, 2053, 2055, 2057, 2059, 2061, 2063, 2065, 2067, 2069, 2071, 2073, 2075, 2077, 2079, 2081, 2083, 2085, 2087, 2089, 2091, 2093, 2095, 2097, 2099, 2101, 2103, 2105, 2107, 2109, 2111, 2113, 2115, 2117, 2119, 2121, 2123, 2125, 2127, 2129, 2131, 2133, and 2135, and a corresponding light chain amino acid sequence set out in SEQ ID NOS: 2233, 2235, 2237, 2239, 2241, 2243, 2245, 2247, 2249, 2251, 2253, 2255, 2257, 2259, 2261, 2263, 2265, 2267, 2269, 2271, 2273, 2275, 2277, 2279, 2281, 2283, 2285, 2287, 2289, 2291, 2293, 2295, 2297, 2299, 2301, 2303, 2305, 2307, 2309, 2311, 2313, 2315, 2317, 2319, 2321, 2323, 2325, 2327, 2329, 2331, 2333, 2335, 2337, 2339, 2341, 2343, 2345, 2347, 2349, 2351, 2353, 2355, and 2357.

Paragraph 95. The antigen binding protein of any one of paragraphs 65 to 84, wherein the antigen-binding moiety is selected from the group consisting of a human antibody, a humanized antibody, a chimeric antibody, a monoclonal antibody, a recombinant antibody, a Fab, a F(ab')2, a Fab2, a monovalent IgG, an scFv, an scFv-Fc, an IgG1 antibody, an IgG2 antibody, an IgG3 antibody, and an IgG4 antibody.

Paragraph 96. The antigen binding protein of any one of paragraphs 65 to 95, wherein the antigen-binding moiety is an IgG.

Paragraph 97. The antigen binding protein of any one of paragraphs 65 to 96, wherein the antigen-binding moiety is an IgG1 antibody.

Paragraph 98. The antigen binding protein of any one of paragraphs 65 to 97 wherein the antigen-binding moiety is a monovalent IgG.

Paragraph 99. The antigen binding protein of any one of paragraphs 65 to 98, wherein the heavy chain constant region of the antigen-binding moiety is selected from heavy chain constant regions of an IgG, IgM, IgA, IgD, IgE, fragments thereof, combinations thereof, and modifications thereof in which one to ten heavy chain framework amino acids are replaced with corresponding amino acid(s) from another human antibody constant region.

Paragraph 100. The antigen binding protein of any one of paragraph 65 to 99 wherein the antigen-binding moiety binds to human PD-1 having the amino acid sequence set forth in SEQ ID NO: 22.

Paragraph 101. The antigen binding protein of any one of paragraphs 65 to 99 wherein the antigen-binding moiety binds to human TREM-1 having the amino acid sequence set forth in SEQ ID NO: 20.

Paragraph 102. The antigen binding protein of any one of paragraphs 65 to 99 or 101 wherein the antigen binding moiety is an anti-TREM-1 antigen-binding moiety comprising:
a. a light chain variable domain comprising:
    i. a light chain CDR1 sequence comprising an amino acid sequence selected from SEQ ID NOS: 30, 50, 70, 90, 110, 130, 150, 170, 190, 210, 230, 250, 270, 290 and 2190;
    ii. a light chain CDR2 sequence comprising an amino acid sequence selected from SEQ ID NOS: 31, 51, 71, 91, 111, 131, 151, 171, 191, 211, 231, 251, 271, 291 and 2190;
    iii. a light chain CDR3 sequence comprising an amino acid sequence selected from SEQ ID NOS: 32, 52, 72, 92, 112, 132, 152, 172, 192, 212, 232, 252, 272, 292 and 2192; and b. a heavy chain variable domain comprising:
    i. a heavy chain CDR1 sequence comprising an amino acid sequence selected from SEQ ID NOS: 36, 56, 76, 96, 116, 136, 156, 176, 196, 216, 236, 256, 276, 296 and 2196;
    ii. a heavy chain CDR2 sequence comprising an amino acid sequence selected from SEQ ID NOS: 37, 57, 77, 97, 117, 137, 157, 177, 197, 217, 237, 257, 277, 297 and 2197; and
    iii. a heavy chain CDR3 sequence comprising an amino acid sequence selected from SEQ ID NOS: 38, 58, 78, 98, 118, 138, 158, 178, 198, 218, 238, 258, 278, 298 and 2198.

Paragraph 103. The antigen binding protein of any one of paragraphs 101 to 102, wherein:
a. the light chain CDR1 sequence is set out in SEQ ID NO: 30, 50, 70, 110, 150, 170, or 290;
b. the light chain CDR2 sequence is set out in SEQ ID NOS: 31, 51, 71, 111, 151, 171, or 291;
c. the light chain CDR3 sequence is set out in SEQ ID NO 32, 52, 72, 112, 152, 172, or 292;
d. the heavy chain CDR1 sequence is set out in SEQ ID NO: 36, 56, 76, 116, 156, 176, and 296;
e. the heavy chain CDR2 sequence is set out in SEQ ID NO: 37, 57, 77, 117, 157, 177, and 297; and
f. the heavy chain CDR3 sequence is set out in SEQ ID NO: 38, 58, 78, 118, 158, 178, and 298.

Paragraph 104. The antigen binding protein of any one of paragraphs 101 to 103, wherein:
a. the light chain CDR1 sequence is set out in SEQ ID NO: 50 and 110;
b. the light chain CDR2 sequence is set out in SEQ ID NOS: 51 and 111;
c. the light chain CDR3 sequence is set out in SEQ ID NOS: 52 and 112;
d. the heavy chain CDR1 sequence is set out in SEQ ID NO: 56 and 116;
e. the heavy chain CDR2 sequence is set out in SEQ ID NO: 57 and 117; and
f. the heavy chain CDR3 sequence is set out in SEQ ID NO: 58 and 118.

Paragraph 105. The antigen-binding protein of any one of paragraphs 101 to 104 wherein the antigen binding moiety is an anti-TREM-1 antigen-binding moiety comprising a set of CDR amino acid sequences selected from:
i) SEQ ID NO: 30 (LCDR1), SEQ ID NO: 31 (LCDR2), SEQ ID NO: 32 (LCDR3), SEQ ID NO: 36 (HCDR1), SEQ ID NO: 37 (HCDR2) and SEQ ID NO: 38 (HCDR3);
ii) SEQ ID NO: 50 (LCDR1), SEQ ID NO: 51 (LCDR2), SEQ ID NO: 52 (LCDR3), SEQ ID NO: 56 (HCDR1), SEQ ID NO: 57 (HCDR2) and SEQ ID NO: 58 (HCDR3);
iii) SEQ ID NO: 70 (LCDR1), SEQ ID NO: 71 (LCDR2), SEQ ID NO: 72 (LCDR3), SEQ ID NO: 76 (HCDR1), SEQ ID NO: 77 (HCDR2) and SEQ ID NO: 78 (HCDR3);
iv) SEQ ID NO: 90 (LCDR1), SEQ ID NO: 91 (LCDR2), SEQ ID NO: 92 (LCDR3), SEQ ID NO: 96 (HCDR1), SEQ ID NO: 97 (HCDR2) and SEQ ID NO: 98 (HCDR3);
v) SEQ ID NO: 110 (LCDR1), SEQ ID NO: 111 (LCDR2), SEQ ID NO: 112 (LCDR3), SEQ ID NO: 116 (HCDR1), SEQ ID NO: 117 (HCDR2) and SEQ ID NO: 118 (HCDR3);

vi) SEQ ID NO: 130 (LCDR1), SEQ ID NO: 131 (LCDR2), SEQ ID NO: 132 (LCDR3), SEQ ID NO: 136 (HCDR1), SEQ ID NO: 137 (HCDR2) and SEQ ID NO: 138 (HCDR3);

vii) SEQ ID NO: 150 (LCDR1), SEQ ID NO: 151 (LCDR2), SEQ ID NO: 152 (LCDR3), SEQ ID NO: 156 (HCDR1), SEQ ID NO: 157 (HCDR2) and SEQ ID NO: 158 (HCDR3);

viii) SEQ ID NO: 170 (LCDR1), SEQ ID NO: 171 (LCDR2), SEQ ID NO: 172 (LCDR3), SEQ ID NO: 176 (HCDR1), SEQ ID NO: 177 (HCDR2) and SEQ ID NO: 178 (HCDR3);

ix) SEQ ID NO: 190 (LCDR1), SEQ ID NO: 191 (LCDR2), SEQ ID NO: 192 (LCDR3), SEQ ID NO: 196 (HCDR1), SEQ ID NO: 197 (HCDR2) and SEQ ID NO: 198 (HCDR3);

x) SEQ ID NO: 210 (LCDR1), SEQ ID NO: 211 (LCDR2), SEQ ID NO: 212 (LCDR3), SEQ ID NO: 216 (HCDR1), SEQ ID NO: 217 (HCDR2) and SEQ ID NO: 218 (HCDR3);

xi) SEQ ID NO: 230 (LCDR1), SEQ ID NO: 231 (LCDR2), SEQ ID NO: 232 (LCDR3), SEQ ID NO: 236 (HCDR1), SEQ ID NO: 237 (HCDR2) and SEQ ID NO: 238 (HCDR3);

xii) SEQ ID NO: 250 (LCDR1), SEQ ID NO: 251 (LCDR2), SEQ ID NO: 252 (LCDR3), SEQ ID NO: 256 (HCDR1), SEQ ID NO: 257 (HCDR2) and SEQ ID NO: 258 (HCDR3);

xiii) SEQ ID NO: 270 (LCDR1), SEQ ID NO: 271 (LCDR2), SEQ ID NO: 272 (LCDR3), SEQ ID NO: 276 (HCDR1), SEQ ID NO: 277 (HCDR2) and SEQ ID NO: 278 (HCDR3);

xiv) SEQ ID NO: 290 (LCDR1), SEQ ID NO: 291 (LCDR2), SEQ ID NO: 292 (LCDR3), SEQ ID NO: 296 (HCDR1), SEQ ID NO: 297 (HCDR2) and SEQ ID NO: 298 (HCDR3); or xv) SEQ ID NO: 2190 (LCDR1), SEQ ID NO: 2191 (LCDR2), SEQ ID NO: 2192 (LCDR3), SEQ ID NO: 2196 (HCDR1), SEQ ID NO: 2197 (HCDR2) and SEQ ID NO: 2198 (HCDR3).

Paragraph 106. The antigen binding protein of any one of paragraphs 101 to 105 wherein the anti-TREM-1 antigen-binding moiety comprises:

a. a light chain variable domain comprising an amino acid sequence selected from the group consisting of:

i. a sequence at least 80% identical to an amino acid sequence selected from SEQ ID NOS: 41, 61, 81, 101, 121, 141, 161, 181, 201, 221, 241, 261, 281, 301 and 2185;

ii. a sequence encoded by a polynucleotide sequence that is at least 80% identical to an amino acid sequence selected from SEQ ID NOS: 41, 61, 81, 101, 121, 141, 161, 181, 201, 221, 241, 261, 281, 301 and 2185;

iii. a sequence encoded by a polynucleotide that hybridizes under moderately stringent conditions to the complement of a polynucleotide consisting of a nucleic acid sequence selected from SEQ ID NOS: 39, 59, 79, 99, 119, 139, 159, 179, 199, 219, 239, 259, 279, 299 and 2183; and b. a heavy chain variable domain comprising an amino acid sequence selected from the group consisting of:

i. a sequence that is at least 80% identical to an amino acid sequence selected from SEQ ID NOS: 42, 62, 82, 102. 122, 142, 162, 182, 202, 222, 242, 262, 282, 302 and 2186;

ii. a sequence encoded by a polynucleotide sequence that is at least 80% identical to an amino acid sequence selected from SEQ ID NOS: 42, 62, 82, 102. 122, 142, 162, 182, 202, 222, 242, 262, 282, 302 and 2186;

iii. a sequence encoded by a polynucleotide that hybridizes under moderately stringent conditions to the complement of a polynucleotide consisting of a nucleic sequence selected from SEQ ID NOS: 40, 60, 80, 100, 120, 140, 160, 180, 200, 220, 240, 260, 280, 300 and 2184.

Paragraph 107. The antigen binding protein of any of paragraphs 101 to 106 wherein the anti-TREM-1 antigen-binding moiety comprises an amino acid sequence at least 90% identical to a heavy chain variable region amino acid sequence selected from SEQ ID NOS: 42, 62, 82, 102, 122, 142, 162, 182, 202, 222, 242, 262, 282, 302 and 2186.

Paragraph 108. The antigen binding protein of any of paragraphs 101 to 107 wherein the anti-TREM-1 antigen-binding moiety comprises a light chain variable region amino acid sequence at least 90% identical to a sequence selected from SEQ ID NOS: 41, 61, 81, 101, 121, 141, 161, 181, 201, 221, 241, 261, 281, 301 and 2185.

Paragraph 109. The antigen binding protein selected from any of paragraphs 101 to 108, wherein one or more heavy chain framework amino acids of the anti-TREM-1 antigen-binding moiety are replaced with corresponding amino acid(s) from another human antibody amino acid sequence.

Paragraph 110. The antigen binding protein of any one of paragraphs 101 to 109 comprising a heavy chain amino acid sequence at least 90% identical to a sequence selected from SEQ ID NOS: 42, 62, 82, 122, 162, 182, and 302 and a light chain amino acid sequence at least 90% identical to a sequence selected from SEQ ID NOS: 41, 61, 81, 121, 161, 181, and 301.

Paragraph 111. The antigen binding protein of any one of paragraphs 101 to 110, wherein:

a. the antigen binding protein comprises two light chains and two heavy chains:

b. each heavy chain comprises an IL-10 moiety attached at the C-terminus of the heavy chain;

c. each heavy-chain-IL-10 moiety antigen binding protein comprises an amino acid sequence at least 90% identical to a sequence selected from SEQ ID NOS: 863, 865, 867, 869, 871, 873, 875, 877, 879, 881, 883, 885, 887, 889, 891, 893, 895, 897, 899, 901, 903, 905, 907, 909, 911, 913, 915, 917, 919, 921, 923, 925, 927, 929, 931, 933, 935, 937, 939, 941, 943, 945, 947, 949, 951, 953, 955, 957, 959, 961, 963, 965, 967, 969, 971, 973, 975, 977, 979, 981, 983, 985, 987, 989, 991, 993, 995, 997, 999, 1001, 1003, 1005, 1007, 1009, 1011, 1013, 1015, 1017, 1019, 1021, 1023, 1025, 1027, 1029, 1031, 1033, 1035, 1037, 1039, 1041, 1043, 1045, 1047, 1049, 1051, 1053, 1055, 1057, 1059, 1061, 1063, 1065, 1067, 1069, 1071, 1073, 1075, 1077, 1079, 1081, 1Q83, and 1085; and d. each light chain-IL-10 moiety comprises an amino acid sequence at least 90% identical to a sequence selected from SEQ ID NOS: 864, 866, 868, 870, 872, 874, 876, 878, 880, 882, 884, 886, 888, 890, 892, 894, 896, 898, 900, 902, 904, 906, 908, 910, 912, 914, 916, 918, 920, 922, 924, 926, 928, 930, 932, 934, 936, 938, 940, 942, 944, 946, 948, 950, 952, 954, 956, 958, 960, 962, 964, 966, 968, 970, 972, 974, 976, 978, 980, 982, 984, 986, 988, 990, 992, 994, 996, 998, 1000, 1002, 1004, 1006, 1008, 1010, 1012, 1014, 1016, 1018, 1020, 1022, 1024, 1026, 1028, 1030, 1032, 1034, 1036, 1038, 1040, 1042, 1044, 1046, 1048, 1050, 1052, 1054, 1056, 1058, 1060, 1062, 1064, 1066, 1068, 1070, 1072, 1074, 1076, 1078, 1080, 1082, 1084, and 1086.

Paragraph 112. The antigen binding protein of any one of paragraphs 101 to 111, wherein the antigen binding protein has a heavy chain-IL-10 moiety amino acid sequence selected from the group consisting of SEQ ID NOS: 2137, 2139, 2141, 2143, 2145, 2147, 2149, 2151, 2153, 2155, 2157, 2159, 2161, 2163, 2165, 2167, 2169, 2171, 2173, 2175, 2177, 2179, 2181, 2359, 2361, 2363, 2365, 2367, 2369, 2371, 2373, 2375, 2377, 2379, 2381, 2383, 2385, 2387, 2389, 2391, 2393, 2395, 2397, 2399, 2401, 2403, 2405, 2407, 2409, 2411, 2143, 2415, 2417, 2419, 2421, 2423, 2425, 2427, 2429, 2431, 2433, 2435, 2437, 2439, 2441, 2443, 2445, 2447, 2449, 2451, 2453, 2455, 2457, 2459, 2461, 2463, 2465, 2467, 2469, 2471, 2473, 2475, 2477, 2479, 2481, 2483, 2485, 2487, 2489, 2491, 2493, 2495, 2497, 2498, 2499, 2501, 2503, 2505, 2507, 2509, 2511, 2513, 2515, 2517, 2519, 2521, 2523, 2525, 2527, 2529, 2531, 2533, 2535, 2537, 2539 and 2726-2776.

Paragraph 113. The antigen binding protein of any one of paragraphs 101 to 111, wherein the antigen binding protein has a heavy chain-IL-10 moiety amino acid sequence selected from the group consisting of SEQ ID NOS: 2727-2732.

Paragraph 114. The antigen binding protein of paragraph 113 comprising the heavy chain amino acid sequence of SEQ ID NO: 2727 or 2728, and the light chain amino acid sequence set out in SEQ ID NO: 976 or SEQ ID NO: 2554.

Paragraph 115. The antigen binding protein of paragraph 113 comprising the heavy chain amino acid sequence of SEQ ID NO: 2729, 2730, 2731 or 2732, and the light chain amino acid sequence set out in and SEQ ID NO: 992 or SEQ ID NO: 2555.

Paragraph 116. The antigen binding protein of any one of paragraphs 101 to 115 wherein the antigen-binding moiety inhibits binding of a TREM-1 ligand to TREM-1.

Paragraph 117. An antigen binding protein comprising an antigen-binding moiety and one or two IL-10 moieties wherein:
   a. the antigen-binding moiety is an antibody or antibody fragment;
   b. each IL-10 moiety is independently monovalent or bivalent;
   c. each IL-10 moiety is independently selected from and one or more human IL-10 muteins having sequences that are 90% identical to SEQ ID NO: 2;
   d. at least one IL-10 moiety is covalently bound to the antigen-binding moiety, and/or
   e. the antigen-binding moiety competes for binding to a human TREM-1 protein with the antigen binding moiety of any one of paragraphs 81 to 116.

Paragraph 118. The antigen binding protein of paragraph 117 wherein the antigen-binding moiety is a human antibody.

Paragraph 119. An isolated nucleic acid molecule comprising a nucleotide sequence that encodes the heavy chain region of the antigen binding protein of any one of paragraphs 65-118.

Paragraph 120. An isolated nucleic acid molecule comprising a nucleotide sequence that encodes the light chain region of the antigen binding protein of any one of paragraphs 65-118.

Paragraph 121. The isolated nucleic acid molecule of paragraph 116, further comprising a nucleotide sequence that encodes the light chain region of the antigen binding protein of any one of paragraphs 65-118.

Paragraph 122. An expression vector comprising the nucleic acid molecule of any one of paragraphs 119-121 operably linked to an expression control sequence.

Paragraph 123. A recombinant host cell comprising the nucleic acid molecule of any one of paragraphs 119-121 or the vector of paragraph 122.

Paragraph 124. The host cell of paragraph 123, wherein the host cell is a mammalian cell.

Paragraph 125. The host cell of paragraph 123 or 124, wherein the host cell is a CHO cell.

Paragraph 126. A method of using the host cell of any of paragraphs 123 to 125 to produce an antigen binding protein, comprising culturing the host cell and recovering said antibody.

Paragraph 127. As antigen binding protein produced by the method of paragraph 126.

Paragraph 128. A pharmaceutical composition comprising the antigen binding protein of any one of paragraphs 65-118 and a pharmaceutically acceptable carrier.

Paragraph 129. A method of treating an inflammatory disease in a subject in a need thereof comprising administering an IL-10 mutein of any one of paragraphs 1-15 or a composition of paragraph 23.

Paragraph 130. The method of paragraph 129 wherein the IL-10 mutein reduces the suppression of TNF-$\alpha$ production in myeloid cells, reduces levels of CD8+ T cell stimulation, and/or reduces the level of B cell stimulation compared to wt IL-10.

Paragraph 131. A method of treating an inflammatory disease in a subject in a need thereof comprising administering an anti-TREM-1 antigen-binding protein of any of paragraphs 24-53 or a composition of paragraph 64.

Paragraph 132. A method of treating an inflammatory disease in a subject in a need thereof comprising administering an antigen binding protein of any one of paragraphs 65-118 or a composition of paragraph 128.

Paragraph 133. The method of any one of paragraphs 129-132, wherein the inflammatory disease is selected from the group consisting of inflammatory bowel disease, ulcerative colitis, Crohn's disease, irritable bowel syndrome, rheumatoid arthritis, psoriasis, psoriatic arthritis, and cytokine release syndrome (CRS).

Paragraph 134. The method of paragraph 133, wherein the inflammatory disease is inflammatory bowel disease.

Paragraph 135. The method of any one of paragraphs 132-134 wherein, the antigen binding protein suppresses TNF-$\alpha$ production in myeloid cells.

Paragraph 136. The method of any one of paragraphs 132-135 wherein, the antigen binding protein suppresses TNF-$\alpha$ production in myeloid cells, but still lacks CD8+ T cell and B cell activation.

Paragraph 137. The method of any one of paragraphs 129 to 136, wherein the treatment is administered intravenously or subcutaneously.

Paragraph 138. The method of any one of paragraphs 129-137, wherein the treatment is administered once weekly, once every two weeks, once every three weeks, once every 4 weeks, once monthly, once every 3 months, or once every six months.

Paragraph 139. The method of any one of paragraphs 129-137, further comprising administering one or two additional therapeutic agents.

Paragraph 140. The method of paragraph 139, wherein the additional therapeutic agents are selected from corticosteroids, NSAIDs, analgesics, immunosuppressive agents, anti-inflammatory agents, TNF$\alpha$ inhibitors, IL-12/IL-23 inhibitors, IL-17 and IFN-$\gamma$.

Paragraph 141. A composition comprising an IL-10 mutein of any one of paragraphs 1-15 for use in treating an inflammatory disease.

Paragraph 142. Use of a composition comprising an IL-10 mutein of any one of paragraphs 1-15 in the preparation of a medicament for treating an inflammatory disease.

Paragraph 143. A composition comprising an anti-TREM-1 antibody or antigen-binding fragment of any one of paragraphs 24-53 for use in treating an inflammatory disease.

Paragraph 144. Use of a composition comprising an anti-TREM-1 antibody or antigen-binding fragment thereof of any one of paragraphs 24-53 in the preparation of a medicament for treating an inflammatory disease.

Paragraph 145. A composition comprising an anti-TREM-1 antibody or antigen-binding fragment of any one of paragraphs 24-53 in combination with an anti-IL-10 mutein of any one of paragraphs 1-15 for use in treating an inflammatory disease.

Paragraph 146. Use of composition comprising an anti-TREM-1 antibody or antigen-binding fragment of any one of paragraphs 24-53 in combination with an anti-IL-10 mutein of any one of paragraphs 1-15 in preparation of a medicament for treating an inflammatory disease.

Paragraph 147. A composition comprising an antigen binding protein of any one of paragraphs 65-118 for use in treating an inflammatory disease.

Paragraph 148. Use of a composition comprising an antigen binding protein of any one of paragraphs 65-118 in the preparation of a medicament for treating an inflammatory disease.

Paragraph 149. A pharmaceutical composition comprising:
   a. an anti-TREM-1 antigen binding protein, and b. an IL-10 mutein of any of paragraphs 1-15.

Paragraph 150. The pharmaceutical composition of paragraph 140 further comprising an anti-TREM-1 antigen binding protein of any of paragraphs 24-53.

Paragraph 151. The use of any one of paragraphs 142, 144, 146, or 148 wherein the inflammatory disease is selected from the group consisting of inflammatory bowel disease, ulcerative colitis, Crohn's disease, irritable bowel syndrome, rheumatoid arthritis, psoriasis, psoriatic arthritis, and cytokine release syndrome (CRS).

Paragraph 152. The composition for use of any one of paragraphs 141, 143, 145, or 147 wherein the inflammatory disease is selected from the group consisting of inflammatory bowel disease, ulcerative colitis, Crohn's disease, irritable bowel syndrome, rheumatoid arthritis, psoriasis, psoriatic arthritis, and cytokine release syndrome (CRS).

Paragraph 153. An isolated antigen binding protein, wherein the antigen binding protein:
   a. is an antibody or antibody fragment;
   b. binds to human TREM-1 having the amino acid sequence set forth in SEQ ID NO: 20;
   c. comprises a light chain variable domain comprising:
      i. a light chain CDR1 comprising an amino acid sequence $X_1$ASQS$X_2X_3X_4$NLA (SEQ ID NO: 2199), wherein $X_1$ is R or Q, wherein $X_2$ is V or I, wherein $X_3$ is N or S, and wherein $X_4$ is S, H, I, V or A;
      ii. a light chain CDR2 comprising an amino acid sequence GA$X_1X_2$RAT (SEQ ID NO: 2200), wherein $X_1$ is S or Y, and wherein $X_2$ is T or I; and
      iii. a light chain CDR3 comprising an amino acid sequence Q$X_1X_2X_3X_4X_5X_6$P$X_7$T (SEQ ID NO: 2201); wherein $X_1$ is Q, H or E, wherein $X_2$ is F or Y, wherein $X_3$ is K, Y or I, wherein $X_4$ is N, T, L, I, or M; wherein $X_5$ is W, F, H or Y, wherein $X_6$ is absent or P; wherein $X_7$ is W, N, Y, H or L; and
   d. comprises a heavy chain variable domain comprising:
      i. a heavy chain CDR1 comprising an amino acid sequence $X_1X_2X_3$M$X_4$ (SEQ ID NO: 2202), wherein $X_1$ is A, R, T or S, wherein $X_2$ is Y or N, wherein $X_3$ is A or W, and wherein $X_4$ is S or N;
      ii. a heavy chain CDR2 comprising an amino acid sequence $X_1X_2X_3X_4X_5X_6$ $X_7$ $X_8$ $X_9$YY$X_{10}$ $X_{11}X_{12}$VKG (SEQ ID NO: 2205), wherein $X_1$ is T, E, or S, wherein $X_2$ is absent or is M, V, or I, wherein $X_3$ is S, R or K, wherein $X_4$ is G or Q, wherein $X_5$ is S, D or H, wherein $X_6$ is G, S L, or A, wherein $X_7$ is S, G, or R, wherein $X_e$ is T, S, P or E, wherein $X_9$ is T or I, wherein $X_{10}$ is A or V, wherein $X_{11}$ is D or E, and wherein $X_{12}$ is S or A; and
      iii. a heavy chain CDR3 comprising an amino acid sequence $X_1X_2X_3X_4X_5X_6$ $X_7$ F $X_8$YY$X_9$ (SEQ ID NO: 2203), wherein $X_1$ is V, E, A or G, wherein $X_2$ is A, F, Y or G, wherein $X_3$ is G, S, Y or W, wherein $X_4$ is S or R, wherein $X_5$ is absent or is N, wherein $X_6$ is F, S, Y, or absent, wherein $X_7$ is L or F or absent, wherein $X_8$ is D or E, and wherein $X_9$ is Y, H or S.

Paragraph 154. The isolated antigen binding protein of paragraph 153, wherein the antigen binding protein comprises:
   a. a light chain variable domain comprising:
   i. a light chain CDR1 comprising an amino acid sequence RASQSVNSNLA (SEQ ID NO: 2212);
   ii. a light chain CDR2 comprising an amino acid sequence GASTRAT (SEQ ID NO: 2219);
   iii. a light chain CDR3 comprising an amino acid sequence QQFKNWPPT (SEQ ID NO: 2222); and
   b. a heavy chain variable domain comprising:
   i. a heavy chain CDR1 comprising an amino acid sequence AYAMS (SEQ ID NO: 2227);
   ii. a heavy chain CDR2 comprising an amino acid sequence TSGSGSTTYYADSVKG (SEQ ID NO: 2230); and
   iii. a heavy chain CDR3 comprising an amino acid sequence VAGSNFLFDY (SEQ ID NO: 2670).

Paragraph 155. An isolated antigen binding protein, wherein the antigen binding protein:
   a. is an antibody or antibody fragment;
   b. binds to human TREM-1 having the amino acid sequence set forth in SEQ ID NO: 20;
   c. comprises a light chain variable domain comprising:
      i. a light chain CDR1 comprising an amino acid sequence QAS$X_1$DI$X_2X_3X_4$LN (SEQ ID NO: 2204), wherein $X_1$ is R or Q, wherein $X_2$ is R, S, N or F, wherein $X_3$ is K or N, and wherein $X_4$ is H, Y or D;
      ii. a light chain CDR2 comprising an amino acid sequence $X_1X_2X_3X_4$LET (SEQ ID NO: 2206), wherein $X_1$ is D, G or H, wherein $X_2$ is A, V or T, wherein $X_3$ is S, A or Y, and wherein $X_4$ is T or N;
      iii. a light chain CDR3 comprising an amino acid sequence Q$X_1$Y$X_3X_4X_5$P$X_6$T (SEQ ID NO: 2207), wherein $X_1$ is Q or H, wherein $X_2$ is D, A or G, wherein $X_3$ is N or K; wherein $X_4$ is L or I, and wherein $X_5$ is I or L; and
   d. comprises a heavy chain variable domain comprising:
      i. a heavy chain CDR1 comprising an amino acid sequence $X_1$YDIN (SEQ ID NO: 2208), wherein $X_1$ is R or S;

ii. a heavy chain CDR2 comprising an amino acid sequence $X_1X_2NPX_3X_4GX_5X_6GX_7X_8$ $X_9X_{10}FX_{11}X_{12}$ (SEQ ID NO: 2209), wherein $X_1$ is W or R, wherein $X_2$ is M or L, wherein $X_3$ is N, Q, or K, wherein $X_4$ is S, A, or R, wherein $X_5$ is N, or Q, wherein $X_6$ is S, A, or T, wherein $X_7$ is S, Q, or Y, wherein $X_8$ is V or T, wherein $X_9$ is Q or K, wherein $X_{10}$ is K or N, wherein $X_{11}$ is R or Q, and wherein $X_{12}$ is G or D; and iii. a heavy chain CDR3 comprising an amino acid sequence $X_1X_2X_3X_4$   $X_5X_6$   $X_7$   $X_8$ $X_9X_{10}X_{11}X_{12}FX_{13}X_{14}$ (SEQ ID NO: 2210); wherein $X_1$ is G, L or R, wherein $X_2$ is G, I, or R, wherein $X_3$ is Y, R, I, G, or A, wherein $X_4$ is T, S, Y, or V, wherein $X_5$ is S or Y, wherein $X_6$ is S, A, I, or R, wherein $X_7$ is W, A, or S, wherein $X_8$ is absent or is S, wherein $X_9$ is absent or is F, W, or Y, and wherein $X_{10}$ is R, S, H, K, or E, wherein $X_{11}$ is W, H, Y, or F, wherein $X_{12}$ is Y, V, A, or S, wherein $X_{13}$ is D or Q, and wherein $X_{14}$ is L, Y, I, or H.

Paragraph 156. The antigen binding protein of paragraph 155, wherein the antigen binding protein comprises:

a. a light chain variable domain comprising:
  i. a light chain CDR1 comprising an amino acid sequence QASQDIRKHLN (SEQ ID NO: 2213);
  ii. a light chain CDR2 comprising an amino acid sequence DASNLET (SEQ ID NO: 2220); and
  iii. a light chain CDR3 comprising an amino acid sequence QHYDNLPIT (SEQ ID NO: 2223); and b. a heavy chain variable domain comprising:
  i. a heavy chain CDR1 comprising an amino acid sequence RYDIN (SEQ ID NO: 2228);
  ii. a heavy chain CDR2 comprising an amino acid sequence WMNPNSGNSSVQKFRG (SEQ ID NO: 2231); and
  iii. a heavy chain CDR3 comprising an amino acid sequence GGYTSSWRWYFDL (SEQ ID NO: 2671) or GGYTSSWSRWYFDL (SEQ ID NO: 2672).

---

SEQUENCE LISTING (2791 sequences)

SEQ ID NO: 1 - DNA, 1327 bp, Artificial Sequence
  Synthetic
gatccccagagactttccagatatctgaagaagtcctgatgtcactgccccggtccttccccaggtagagcaacactcctcgtcgcaacccaactggctccccttaccttctacacacacacacacacacacacacacacacacacacacacacacaaatccaagacaacactactaaggcttctttgggagggggaagtagggataggtaagaggaaagtaagggacctcctatccagcctccatggaatcctgacttcttttccttgttatttcaacttcttccaccccatcttttaaactttagactccagccacagaagcttacaactaaaagaaactctaaggccaatttaatccaaggtttcattctatgtgctggagatggtgtacagtagggtgaggaaaccaaattctcagttggcactggtgtacccttgtacaggtgatgtaacatctctgtgcctcagtttgctcactataaaatagagacggtaggggtcatggtgagcactacctgactagcatataagaagctttcagcaagtgcagactactcttacccacttcccccaagcacagttggggtgggggacagctgaagaggtggaaacatgtgcctgagaatcctaatgaaatcggggtaaaggagcctggaacacatcctgtgaccccgcctgtcctgtaggaagccagtctctggaaagtaaaatggaagggctgcttgggaactttgaggatatttagcccaccccctcatttttacttggggaaactaaggcccagagacctaaggtgactgcctaagttagcaaggagaagtcttgggtattcatcccaggttggggggacccaattatttctcaatcccattgtattctggaatgggcaatttgtccacgtcactgtgacctaggaacacgcgaatgagaacccacagctgagggcctctgcgcacagaacagctgttctccccaggaaatcaactttttttaattgagaagctaaaaaattattctaagagaggtagcccatcctaaaaatagctgtaatgcagaagttcatgttcaaccaatcatttttgcttacgatgcaaaaattgaaaactaagtttattagagaggttagagaaggaggagctctaagcagaaaaaatcctgtgccgggaaaccttgattgtggctttttaatgaatgaagaggcctccctgagcttacaatataaaagggggacagagaggtgaaggtctacacatcaggggcttgctcttgcaaaaccaaaccacaagacagacttgcaaaagaaggcatgcacagctcagcactgc

SEQ ID NO: 2 - protein, 160 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENKSKAVEQVKNAFNKLQEKGIYKAMSEFDIFINYIEAYMTMKIRN

SEQ ID NO: 3 - protein, 166 aa, Artificial Sequence
  Synthetic
SPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 4 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 5 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 6 - protein, 166 aa, Artificial Sequence
  Synthetic
SPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 7 - protein, 166 aa, Artificial Sequence
  Synthetic
SPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 8 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 9 - protein, 166 aa, Artificial Sequence
  Synthetic
SPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 10 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 11 - DNA, 498 bp, Artificial Sequence
  Synthetic
tctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaac

SEQ ID NO: 12 - DNA, 498 bp, Artificial Sequence
  Synthetic
tctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaac

SEQ ID NO: 13 - DNA, 498 bp, Artificial Sequence
  Synthetic
tctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaac

SEQ ID NO: 14 - DNA, 498 bp, Artificial Sequence
  Synthetic
tctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaac

SEQ ID NO: 15 - DNA, 498 bp, Artificial Sequence
  Synthetic
tctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaac

SEQ ID NO: 16 - DNA, 498 bp, Artificial Sequence
  Synthetic
tctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaac

SEQ ID NO: 17 - DNA, 498 bp, Artificial Sequence
  Synthetic
tctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaac

SEQ ID NO: 18 - DNA, 498 bp, Artificial Sequence
  Synthetic
tctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaac

SEQ ID NO: 19 - DNA, 905 bp, Artificial Sequence
  Synthetic
gtcccgggagccctcagcagcagttggagctggtgcacaggaaggatgaggaagaccaggctctgggggctgctgtggatgctctttgtctcagaactccgagctgcaactaaattaactgaggaaaagtatgaactgaaagaggggcagaccctggatgtgaaatgtgactacacgctagagaagtttgccagcagccagaaagcttggcagataataagggacggagagatgcccaagaccctggcatgcacagagaggccttcaaagaattcccatccagtccaagtggggaggatcatactagaagactaccatgatcatggtttactgcgcgtccgaatggtcaaccttcaagtggaagattctggactgtatcagtgtgtgatctaccagcctcccaaggagcctcacatgctgttcgatcgcatccgcttggtggtgaccaagggtttttcagggacccctggctccaatgagaattctacccagaatgtgtataagattcctcctaccaccactaaggccttgtgcccactctataccagccccagaactgtgacccaagctccacccaagtcaactgccgatgtctccactcctgactctgaaatcaaccttacaaatgtgacagatatcatcagggttccggtgttcaacattgtcattctcctggctggtggattcctgagtaagagcctggtcttctctgtcctgtttgctgtcacgctgaggtcatttgtaccctaggcccacgaacccacgagaatgtcctctgacttccagccacatccatctggcagttgtgccaagggaggagggaggaggtaaaaggcagggagttaataacatgaattaaatctgtaatcaccgccaaaaaaaaaaaaaaaaaaaaaaaaaaaaaa

SEQ ID NO: 20 - protein, 234 aa, Artificial Sequence
  Synthetic
MRKTRLWGLLWMLFVSELRAATKLTEEKYELKEGQTLDVKCDYTLEKFASSQKAWQIIRDGEMPKTLACTERPSKNSHPVQVGRIILEDYHDHGLLRVRMVNLQVEDSGLYQCVIYQPPKEPHMLFDRIRLVVTKGFSGTPGSNENSTQNVYKIPPTTTKALCPLYTSPRTVTQAPPKSTADVSTPDSEINLTNVTDIIRVPVFNIVILLAGGFLSKSLVFSVLFAVTLRSFVP

SEQ ID NO: 21 - DNA, 921 bp, Artificial Sequence
  Synthetic
cactctggtggggctgctccaggcatgcagatcccacaggcgccctggccagtcgtctgggcggtgctacaactgggctggcggccaggatggttcttagactccccagacaggccctggaacccccccaccttctccccagccctgctcgtggtgaccgaaggggacaacgccaccttcacctgcagcttctccaacacatcggagagcttcgtgctaaactggtaccgcatgagccccagcaaccagacggacaagctggccgccttccccgaggaccgcagccagcccggccaggactgccgcttccgtgtcacacaactgcccaacgggcgtgacttccacatgagcgtggtcagggcccggcgcaatgacagcggcacctacctctgtggggccatctccctggcccccaaggcgcagatcaaagagagcctgcgggcagagctcagggtgacagagagaagggcagaagtgcccacagcccaccccagcccctcacccaggtcagccggccagttccaaaccctggtggttggtgtcgtgggcggcctgctgggcagcctggtgctgctagtctgggtcctggccgtcatctgctcccgggccgcacgagggacaataggagccaggcgcaccggccagcccctgaaggaggacccctcagccgtgcctgtgttctctgtggactatggggagctggatttccagtggcgagagaagaccccggagccccccgtgccctgtgtccctgagcagacggagtatgccaccattgtctttcctagcggaatgggcacctcatcccccgcccgcaggggctcagctgacggccctcggagtgcccagccactgaggcctgaggatggacactgctcttggcccctctgaccggcttccttggccaccagtgttctgcag

SEQ ID NO: 22 - protein, 288 aa, Artificial Sequence [sequence omitted]

SEQ ID NO: 23 - DNA, 708 bp, Artificial Sequence
  Synthetic
atggacatgagggtgcccgctcagctcctggggctcctgctgctgtggctgagaggtgcgcgctgtgacatccagatgacccagtttccatcttccgtgtctgcatctgtaggagacagagtcaccatcacttgtcgggcgagtcaggggattagcaggtggttagcctggtatcagcagaaacaagggaaagcccctaagctcctgatctatatggtatccagtttgcaaagtggggtcccatcaaggttcagtggcagtggatctgggacagatttcactctcaccatcagcagcctgcagcctgaagattttgcaacttactattgtcagcagtctcacaatttcccgatcaccttcggccaagggacacgactggacattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 24 - DNA, 1413 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtctcttcagccagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggcaaa

SEQ ID NO: 25 - protein, 236 aa, Artificial Sequence
  Synthetic
MDMRVPAQLLGLLLLWLRGARCDIQMTQFPSSVSASVGDRVTITCRASQGISRWLAWYQQKQGKAPKLLIYMVSSLQSGVPSRFSGSGSGTDFTLTISSLQPEDFATYYCQQSHNFPITFGQGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26 - protein, 471 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 27 - DNA, 33 bp, Artificial Sequence
  Synthetic
cgggcgagtcaggggattagcaggtggttagcc

SEQ ID NO: 28 - DNA, 21 bp, Artificial Sequence
  Synthetic
atggtatccagtttgcaaagt

SEQ ID NO: 29 - DNA, 27 bp, Artificial Sequence
  Synthetic
cagcagtctcacaatttcccgatcacc

SEQ ID NO: 30 - protein, 11 aa, Artificial Sequence
  Synthetic
RASQGISRWLA

SEQ ID NO: 31 - protein, 7 aa, Artificial Sequence
  Synthetic
MVSSLQS

SEQ ID NO: 32 - protein, 9 aa, Artificial Sequence
  Synthetic
QQSHNFPIT

SEQ ID NO: 33 - DNA, 15 bp, Artificial Sequence
  Synthetic
ggctactatatgcac

SEQ ID NO: 34 - DNA, 51 bp, Artificial Sequence
  Synthetic
tggttcaaacctaatagtggtgtcacaaactatgcacagaagtttcagggc

SEQ ID NO: 35 - DNA, 39 bp, Artificial Sequence
  Synthetic
gccggatacagcaccagttggaaagactggttcgacccc

SEQ ID NO: 36 - protein, 5 aa, Artificial Sequence
  Synthetic
GYYMH

SEQ ID NO: 37 - protein, 17 aa, Artificial Sequence
  Synthetic
WFKPNSGVTNYAQKFQG

SEQ ID NO: 38 - protein, 13 aa, Artificial Sequence
  Synthetic
AGYSTSWKDWFDP

SEQ ID NO: 39 - DNA, 321 bp, Artificial Sequence
  Synthetic
gacatccagatgacccagtttccatcttccgtgtctgcatctgtaggagacagagtcaccatcacttgtcgggcgagtcaggggattagcaggtggttagcctggtatcagcagaaacaagggaaagcccctaagctcctgatctatatggtatccagtttgcaaagtggggtcccatcaaggttcagtggcagtggatctgggacagatttcactctcaccatcagcagcctgcagcctgaagattttgcaacttactattgtcagcagtctcacaatttcccgatcaccttcggccaagggacacgactggacattaaa

SEQ ID NO: 40 - DNA, 366 bp, Artificial Sequence
  Synthetic
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtctcttca

SEQ ID NO: 41 - protein, 107 aa, Artificial Sequence
  Synthetic
DIQMTQFPSSVSASVGDRVTITCRASQGISRWLAWYQQKQGKAPKLLIYMVSSLQSGVPSRFSGSGSGTDFTLTISSLQPEDFATYYCQQSHNFPITFGQGTRLDIK

SEQ ID NO: 42 - protein, 122 aa, Artificial Sequence
  Synthetic
QVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSS

SEQ ID NO: 43 - DNA, 708 bp, Artificial Sequence
  Synthetic
atggacatgagggtgcccgctcagctcctggggctcctgctgctgtggctgagaggtgcgcgctgtgacacccagatgacccagtctccatcctccctgtctgcatctgaaggagacagagtcaccatcacttgccaggcgagtcaggacattttcaacgatttaaattggtatcaggagaaaccagggaaagcccctaagctcctgatctaccatgcatccaatttggaaacaggggtcccatcaaggttcagtggaagtggatctgggacagattatactttcaccatcagcagcctgcagcctgaagatattgctacatattactgtcaacaatatggaaatctcccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 44 - DNA, 1419 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccaggaacacctccataagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagccagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggcaaa

SEQ ID NO: 45 - protein, 236 aa, Artificial Sequence
  Synthetic
MDMRVPAQLLGLLLLWLRGARCDTQMTQSPSSLSASEGDRVTITCQASQDIFNDLNWYQEKPGKAPKLLIYHASNLETGVPSRFSGSGSGTDYTFTISSLQPEDIATYYCQQYGNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 46 - protein, 473 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRNTSISTAYMELSSLRSEDTAVYYCARRRAVYRSSWEWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 47 - DNA, 33 bp, Artificial Sequence
  Synthetic
caggcgagtcaggacattttcaacgatttaaat

SEQ ID NO: 48 - DNA, 21 bp, Artificial Sequence
  Synthetic
catgcatccaatttggaaaca

SEQ ID NO: 49 - DNA, 27 bp, Artificial Sequence
  Synthetic
caacaatatggaaatctcccgctcact

SEQ ID NO: 50 - protein, 11 aa, Artificial Sequence
  Synthetic
QASQDIFNDLN

SEQ ID NO: 51 - protein, 7 aa, Artificial Sequence
  Synthetic
HASNLET

SEQ ID NO: 52 - protein, 9 aa, Artificial Sequence
  Synthetic
QQYGNLPLT

SEQ ID NO: 53 - DNA, 15 bp, Artificial Sequence
  Synthetic
agttatgatatcaac

SEQ ID NO: 54 - DNA, 51 bp, Artificial Sequence
  Synthetic
tggatgaaccctaacaggggtaacacaggctatgtaaagaagttccagggc

SEQ ID NO: 55 - DNA, 45 bp, Artificial Sequence
  Synthetic
aggagggccgtgtatcgcagcagctgggagtggtacttcgatctc

SEQ ID NO: 56 - protein, 5 aa, Artificial Sequence
  Synthetic
SYDIN

SEQ ID NO: 57 - protein, 17 aa, Artificial Sequence
  Synthetic
WMNPNRGNTGYVKKFQG

SEQ ID NO: 58 - protein, 15 aa, Artificial Sequence
  Synthetic
RRAVYRSSWEWYFDL

SEQ ID NO: 59 - DNA, 321 bp, Artificial Sequence
  Synthetic
gacacccagatgacccagtctccatcctccctgtctgcatctgaaggagacagagtcaccatcacttgccaggcgagtcaggacattttcaacgatttaaattggtatcaggagaaaccagggaaagcccctaagctcctgatctaccatgcatccaatttggaaacaggggtcccatcaaggttcagtggaagtggatctgggacagattatactttcaccatcagcagcctgcagcctgaagatattgctacatattactgtcaacaatatggaaatctcccgctcactttcggcggagggaccaaggtggagatcaaa

SEQ ID NO: 60 - DNA, 372 bp, Artificial Sequence
  Synthetic
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccaggaacacctccataagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctca

SEQ ID NO: 61 - protein, 107 aa, Artificial Sequence
  Synthetic
DTQMTQSPSSLSASEGDRVTITCQASQDIFNDLNWYQEKPGKAPKLLIYHASNLETGVPSRFSGSGSGTDYTFTISSLQPEDIATYYCQQYGNLPLTFGGGTKVEIK

SEQ ID NO: 62 - protein, 124 aa, Artificial Sequence
  Synthetic
QVQLVQSGAEVKKPGASVKVSCKASGYTFTSYDINWVRQATGQGLEWMGWMNPNRGNTGYVKKFQGRVTMTRNTSISTAYMELSSLRSEDTAVYYCARRRAVYRSSWEWYFDLWGRGTLVTVSS

SEQ ID NO: 63 - DNA, 708 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcaggacattagcaaacatttaaattggtatcagcagaaaccagggaaagcccctaagctcctgatctacgatacctccaatttggaaacaggggtcccatcaaggttcagtggaagtggatctgggacagattttactttcaccatcagcagcctgcagcctgaagatattgcaacatataactgtcaacagtatgataagctcccgctcactttcggcggagggaccaaggtggagatcaagcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 64 - DNA, 1413 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccaggaacacctccataagcacagcctacatggagctgagcagcctgagatctgaggacacggccgtgtattactgtgcgagaggcgggcgtaccagcatctggtccttcgtctttgattactggggccagggcaccctggtcaccgtctcctcagccagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggcaaa

SEQ ID NO: 65 - protein, 236 aa, Artificial Sequence
  Synthetic
MDMRVPAQLLGLLLLWLRGARCDIQMTQSPSSLSASVGDRVTITCQASQDISKHLNWYQQKPGKAPKLLIYDTSNLETGVPSRFSGSGSGTDFTFTISSLQPEDIATYNCQQYDKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 66 - protein, 471 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRNTSISTAYMELSSLRSEDTAVYYCARGGRTSIWSFVFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 67 - DNA, 33 bp, Artificial Sequence
  Synthetic
caggcgagtcaggacattagcaaacatttaaat

SEQ ID NO: 68 - DNA, 21 bp, Artificial Sequence
  Synthetic
gatacctccaatttggaaaca

SEQ ID NO: 69 - DNA, 27 bp, Artificial Sequence
  Synthetic
caacagtatgataagctcccgctcact

SEQ ID NO: 70 - protein, 11 aa, Artificial Sequence
  Synthetic
QASQDISKHLN

SEQ ID NO: 71 - protein, 7 aa, Artificial Sequence
  Synthetic
DTSNLET

SEQ ID NO: 72 - protein, 9 aa, Artificial Sequence
  Synthetic
QQYDKLPLT

SEQ ID NO: 73 - DNA, 15 bp, Artificial Sequence
  Synthetic
agttatgatatcaac

SEQ ID NO: 74 - DNA, 51 bp, Artificial Sequence
  Synthetic
aggatgaaccctaagagtggtaatgcaggctatgtacagaacttccggggc

SEQ ID NO: 75 - DNA, 39 bp, Artificial Sequence
  Synthetic
ggcgggcgtaccagcatctggtccttcgtctttgattac

SEQ ID NO: 76 - protein, 5 aa, Artificial Sequence
  Synthetic
SYDIN

SEQ ID NO: 77 - protein, 17 aa, Artificial Sequence
  Synthetic
RMNPKSGNAGYVQNFRG

SEQ ID NO: 78 - protein, 13 aa, Artificial Sequence
  Synthetic
GGRTSIWSFVFDY

SEQ ID NO: 79 - DNA, 321 bp, Artificial Sequence
  Synthetic
gacatccagatgacccagtctccatcctccctgtctgcatctgtaggagacagagtcaccatcacttgccaggcgagtcaggacattagcaaacatttaaattggtatcagcagaaaccagggaaagcccctaagctcctgatctacgatacctccaatttggaaacaggggtcccatcaaggttcagtggaagtggatctgggacagattttactttcaccatcagcagcctgcagcctgaagatattgcaacatataactgtcaacagtatgataagctcccgctcactttcggcggagggaccaaggtggagatcaag

SEQ ID NO: 80 - DNA, 366 bp, Artificial Sequence
  Synthetic
caggtgcagctggtgcagtctggggctgaggtgaagaagcctggggcctcagtgaaggtctcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccaggaacacctccataagcacagcctacatggagctgagcagcctgagatctgaggacacggccgtgtattactgtgcgagaggcgggcgtaccagcatctggtccttcgtctttgattactggggccagggcaccctggtcaccgtctcctca

SEQ ID NO: 81 - protein, 107 aa, Artificial Sequence
  Synthetic
DIQMTQSPSSLSASVGDRVTITCQASQDISKHLNWYQQKPGKAPKLLIYDTSNLETGVPSRFSGSGSGTDFTFTISSLQPEDIATYNCQQYDKLPLTFGGGTKVEIK

SEQ ID NO: 82 - protein, 122 aa, Artificial Sequence
  Synthetic
QVQLVQSGAEVKKPGASVKVSCKASGYTFTSYDINWVRQATGQGLEWMGRMNPKSGNAGYVQNFRGRVTMTRNTSISTAYMELSSLRSEDTAVYYCARGGRTSIWSFVFDYWGQGTLVTVSS

SEQ ID NO: 83 - DNA, 708 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcgggacattagcaagtatttaaattggtatcaacagaaaccagggaaagcccccaaactccagatctacgatgcatccaatttggaaacaggggtcccatcaaggttcagtggaagtggatctgggacagattttactttcaccatcagcagcctgcagcctgaagatattgcaacatattactgtcaacactatgataatatcccgatcacctttggccaggggacaagactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 84 - DNA, 1416 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtctcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccaggaacacctccataagcactgcctacatggaattgagcagcctgagatctgaggacacggccgtgtattactgtgtgagacttatagggtatagcagtgcctggaagtggtccttccagcactggggccagggcaccctggtcaccgtctcctcagccagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggcaaa

SEQ ID NO: 85 - protein, 236 aa, Artificial Sequence
  Synthetic
MDMRVPAQLLGLLLLWLRGARCDIQMTQSPSSLSASVGDRVTITCQASRDISKYLNWYQQKPGKAPKLQIYDASNLETGVPSRFSGSGSGTDFTFTISSLQPEDIATYYCQHYDNIPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 86 - protein, 472 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRNTSISTAYMELSSLRSEDTAVYYCVRLIGYSSAWKWSFQHWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 87 - DNA, 33 bp, Artificial Sequence
  Synthetic
caggcgagtcgggacattagcaagtatttaaat

SEQ ID NO: 88 - DNA, 21 bp, Artificial Sequence
  Synthetic
gatgcatccaatttggaaaca

SEQ ID NO: 89 - DNA, 27 bp, Artificial Sequence
  Synthetic
caacactatgataatatcccgatcacc

SEQ ID NO: 90 - protein, 11 aa, Artificial Sequence
  Synthetic
QASRDISKYLN

SEQ ID NO: 91 - protein, 7 aa, Artificial Sequence
  Synthetic
DASNLET

SEQ ID NO: 92 - protein, 9 aa, Artificial Sequence
  Synthetic
QHYDNIPIT

SEQ ID NO: 93 - DNA, 15 bp, Artificial Sequence
  Synthetic
agttatgatatcaat

SEQ ID NO: 94 - DNA, 51 bp, Artificial Sequence
  Synthetic
tggatgaaccctaacagtggtaactcaggctctgtaaagaagttccgggac

SEQ ID NO: 95 - DNA, 42 bp, Artificial Sequence
  Synthetic
cttatagggtatagcagtgcctggaagtggtccttccagcac

SEQ ID NO: 96 - protein, 5 aa, Artificial Sequence
  Synthetic
SYDIN

SEQ ID NO: 97 - protein, 17 aa, Artificial Sequence
  Synthetic
WMNPNSGNSGSVKKFRD

SEQ ID NO: 98 - protein, 14 aa, Artificial Sequence
  Synthetic
LIGYSSAWKWSFQH

SEQ ID NO: 99 - DNA, 321 bp, Artificial Sequence
  Synthetic
gacatccagatgacccagtctccatcctccctgtctgcatctgtaggagacagagtcaccatcacttgccaggcgagtcgggacattagcaagtatttaaattggtatcaacagaaaccagggaaagcccccaaactccagatctacgatgcatccaatttggaaacaggggtcccatcaaggttcagtggaagtggatctgggacagattttactttcaccatcagcagcctgcagcctgaagatattgcaacatattactgtcaacactatgataatatcccgatcacctttggccaggggacaagactggagattaaa

SEQ ID NO: 100 - DNA, 369 bp, Artificial Sequence
  Synthetic
caggtgcagctggtgcagtctggggctgaggtgaagaagcctggggcctcagtgaaggtctcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccaggaacacctccataagcactgcctacatggaattgagcagcctgagatctgaggacacggccgtgtattactgtgtgagacttatagggtatagcagtgcctggaagtggtccttccagcactggggccagggcaccctggtcaccgtctcctca

SEQ ID NO: 101 - protein, 107 aa, Artificial Sequence
  Synthetic
DIQMTQSPSSLSASVGDRVTITCQASRDISKYLNWYQQKPGKAPKLQIYDASNLETGVPSRFSGSGSGTDFTFTISSLQPEDIATYYCQHYDNIPITFGQGTRLEIK

SEQ ID NO: 102 - protein, 123 aa, Artificial Sequence
  Synthetic
QVQLVQSGAEVKKPGASVKVSCKASGYTFTSYDINWVRQATGQGLEWMGWMNPNSGNSGSVKKFRDRVTMTRNTSISTAYMELSSLRSEDTAVYYCVRLIGYSSAWKWSFQHWGQGTLVTVSS

SEQ ID NO: 103 - DNA, 708 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcaggacattaacaaccatttaaattggtatcagcagaaaccggggaaagcccctaagctcctgatctacggtgcatacactttggaaacaggggtcccatcaaggttcagtggaagtggctctgggacagattttactttcaccatcagcagcctgcagcctgaagatattgctacatattactgtcaacagtatgataagctcccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 104 - DNA, 1413 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtctcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccaggaacacctccataaccacagtctatatggaactgagcagcctgagatctgatgacacggccgtgtattactgtgcgagaggaggaattagcagcagctggcactgggcttttgatatctggggccaagggacaatggtcaccgtctcttcagccagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggcaaa

SEQ ID NO: 105 - protein, 236 aa, Artificial Sequence
  Synthetic
MDMRVPAQLLGLLLLWLRGARCDIQMTQSPSSLSASVGDRVTITCQASQDINNHLNWYQQKPGKAPKLLIYGAYTLETGVPSRFSGSGSGTDFTFTISSLQPEDIATYYCQQYDKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 106 - protein, 471 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRNTSITTVYMELSSLRSDDTAVYYCARGGISSSWHWAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 107 - DNA, 33 bp, Artificial Sequence
  Synthetic
caggcgagtcaggacattaacaaccatttaaat

SEQ ID NO: 108 - DNA, 21 bp, Artificial Sequence
  Synthetic
ggtgcatacactttggaaaca

SEQ ID NO: 109 - DNA, 27 bp, Artificial Sequence
  Synthetic
caacagtatgataagctcccgctcact

SEQ ID NO: 110 - protein, 11 aa, Artificial Sequence
  Synthetic
QASQDINNHLN

SEQ ID NO: 111 - protein, 7 aa, Artificial Sequence
  Synthetic
GAYTLET

SEQ ID NO: 112 - protein, 9 aa, Artificial Sequence
  Synthetic
QQYDKLPLT

SEQ ID NO: 113 - DNA, 15 bp, Artificial Sequence
  Synthetic
agatatgatatcaac

SEQ ID NO: 114 - DNA, 51 bp, Artificial Sequence
  Synthetic
tggatgaaccctaacagtggtaattcaggctctgtacagaaattccggggc

SEQ ID NO: 115 - DNA, 39 bp, Artificial Sequence
  Synthetic
ggaggaattagcagcagctggcactgggcttttgatatc

SEQ ID NO: 116 - protein, 5 aa, Artificial Sequence
  Synthetic
RYDIN

SEQ ID NO: 117 - protein, 17 aa, Artificial Sequence
  Synthetic
WMNPNSGNSGSVQKFRG

SEQ ID NO: 118 - protein, 13 aa, Artificial Sequence
  Synthetic
GGISSSWHWAFDI

SEQ ID NO: 119 - DNA, 321 bp, Artificial Sequence
  Synthetic
gacatccagatgacccagtctccatcctccctgtctgcatctgtaggagacagagtcaccatcacttgccaggcgagtcaggacattaacaaccatttaaattggtatcagcagaaaccggggaaagcccctaagctcctgatctacggtgcatacactttggaaacaggggtcccatcaaggttcagtggaagtggctctgggacagattttactttcaccatcagcagcctgcagcctgaagatattgctacatattactgtcaacagtatgataagctcccgctcactttcggcggagggaccaaggtggagatcaaa

SEQ ID NO: 120 - DNA, 366 bp, Artificial Sequence
  Synthetic
caggtgcaactggtgcagtctggggctgaggtgacgaagcctggggcctcagtgaaggtctcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccaggaacacctccataaccacagtctatatggaactgagcagcctgagatctgatgacacggccgtgtattactgtgcgagaggaggaattagcagcagctggcactgggcttttgatatctggggccaagggacaatggtcaccgtctcttca

SEQ ID NO: 121 - protein, 107 aa, Artificial Sequence
  Synthetic
DIQMTQSPSSLSASVGDRVTITCQASQDINNHLNWYQQKPGKAPKLLIYGAYTLETGVPSRFSGSGSGTDFTFTISSLQPEDIATYYCQQYDKLPLTFGGGTKVEIK

SEQ ID NO: 122 - protein, 122 aa, Artificial Sequence
  Synthetic
QVQLVQSGAEVTKPGASVKVSCKASGYTFTRYDINWVRQATGQGLEWMGWMNPNSGNSGSVQKFRGRVTMTRNTSITTVYMELSSLRSDDTAVYYCARGGISSSWHWAFDIWGQGTMVTVSS

SEQ ID NO: 123 - DNA, 708 bp, Artificial Sequence
  Synthetic
atggacatgagggtgcccgctcagctcctggggctcctgctgctgtggctgagaggtgcgcgctgtgacatccagatgacccagtctccatcttccctgtctgcatctgtaggagacagagtcaccatcacttgccgggcaagtcagagcattagcagcaatttaaattggtatcagcagaaaccagggaaagcccctaagctcctgatctctgctgcatccaatttgcaaagtggggtcccatcaaggttcagtggcagtgaatctgggacagatttcactctcaccatcagcagtctacaatctgaagattttgcaacttactactgtcaacagagtgacagtctcccgctcactttcggcggagggaccaaggtggagatcaatcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 124 - DNA, 1404 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtctcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagccagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggcaaa

SEQ ID NO: 125 - protein, 236 aa, Artificial Sequence
  Synthetic
MDMRVPAQLLGLLLLWLRGARCDIQMTQSPSSLSASVGDRVTITCRASQSISSNLNWYQQKPGKAPKLLISAASNLQSGVPSRFSGSESGTDFTLTISSLQSEDFATYYCQQSDSLPLTFGGGTKVEINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 126 - protein, 468 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 127 - DNA, 33 bp, Artificial Sequence
  Synthetic
cgggcaagtcagagcattagcagcaatttaaat

SEQ ID NO: 128 - DNA, 21 bp, Artificial Sequence
  Synthetic
gctgcatccaatttgcaaagt

SEQ ID NO: 129 - DNA, 27 bp, Artificial Sequence
  Synthetic
caacagagtgacagtctcccgctcact

SEQ ID NO: 130 - protein, 11 aa, Artificial Sequence
  Synthetic
RASQSISSNLN

SEQ ID NO: 131 - protein, 7 aa, Artificial Sequence
  Synthetic
AASNLQS

SEQ ID NO: 132 - protein, 9 aa, Artificial Sequence
  Synthetic
QQSDSLPLT

SEQ ID NO: 133 - DNA, 15 bp, Artificial Sequence
  Synthetic
agctatgccatgacc

SEQ ID NO: 134 - DNA, 51 bp, Artificial Sequence
  Synthetic
actattagtggtagtggtagtaacacatactacgcagactccgtgaagggc

SEQ ID NO: 135 - DNA, 30 bp, Artificial Sequence
  Synthetic
gaggggggcagtaaccgatacttccaccac

SEQ ID NO: 136 - protein, 5 aa, Artificial Sequence
  Synthetic
SYAMT

SEQ ID NO: 137 - protein, 17 aa, Artificial Sequence
  Synthetic
TISGSGSNTYYADSVKG

SEQ ID NO: 138 - protein, 10 aa, Artificial Sequence
  Synthetic
EGGSNRYFHH

SEQ ID NO: 139 - DNA, 321 bp, Artificial Sequence
  Synthetic
gacatccagatgacccagtctccatcttccctgtctgcatctgtaggagacagagtcaccatcacttgccgggcaagtcagagcattagcagcaatttaaattggtatcagcagaaaccagggaaagcccctaagctcctgatctctgctgcatccaatttgcaaagtggggtcccatcaaggttcagtggcagtgaatctgggacagatttcactctcaccatcagcagtctacaatctgaagattttgcaacttactactgtcaacagagtgacagtctcccgctcactttcggcggagggaccaaggtggagatcaat

SEQ ID NO: 140 - DNA, 357 bp, Artificial Sequence
  Synthetic
gaggtgcagctgttggagtctgggggaggcttggtacagcctggggggtccctgagactctcctgtgcagcctctggattcacctttagcagctatgccatgacctgggtccgccaggctccagggagggggctgcagtgggtctcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctca

SEQ ID NO: 141 - protein, 107 aa, Artificial Sequence
  Synthetic
DIQMTQSPSSLSASVGDRVTITCRASQSISSNLNWYQQKPGKAPKLLISAASNLQSGVPSRFSGSESGTDFTLTISSLQSEDFATYYCQQSDSLPLTFGGGTKVEIN

SEQ ID NO: 142 - protein, 119 aa, Artificial Sequence
  Synthetic
EVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISS

SEQ ID NO: 143 - DNA, 708 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcaggacattaacaaccatttaaattggtatcagcagaaaccagggaaagcccctaagctcctgatctacgatgtatccaatttggaaacaggggtcccatcaagtttcagtggaagtggatgtgggacagattttactttcaccatcagcagcctgcagcctgaagatatcgcaacatatttctgtcaacagtatgataaactcccgctcacttttggcggagggaccaaggtggagatcgaaggaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 144 - DNA, 1413 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtctcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccaggaacacctccataaatacagcctacatggagctgagcagcctgagatctgaggacacggccgtgtattactgtgcgagaggggggtataccagtgcctggagatggtacttcgatctctggggccgtggcaccctggtcactgtctcctcagccagcaccaaggggccatccgtcttccccctggcgccctgctccaggagcacctccgagagcacagccgccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacgaagacctacacctgcaacgtagatcacaagcccagcaacaccaaggtggacaagagagttgagtccaaatatggtcccccatgcccatcatgcccagcacctgagttcctggggggaccatcagtcttcctgttccccccaaaacccaaggacactctcatgatctcccggacccctgaggtcacgtgcgtggtggtggacgtgagccaggaagaccccgaggtccagttcaactggtacgtggatggcgtggaggtgcataatgccaagacaaagccgcgggaggagcagttcaacagcacgtaccgtgtggtcagcgtcctcaccgtcctgcaccaggactggctgaacggcaaggagtacaagtgcaaggtctccaacaaaggcctcccgtcctccatcgagaaaaccatctccaaagccaaagggcagccccgagagccacaggtgtacaccctgcccccatcccaggaggagatgaccaagaaccaggtcagcctgacctgcctggtcaaaggcttctaccccagcgacatcgccgtggagtgggagagcaatgggcagccggagaacaactacaagaccacgcctcccgtgctggactccgacggctccttcttcctctacagcaggctaaccgtggacaagagcaggtggcaggaggggaatgtcttctcatgctccgtgatgcatgaggctctgcacaaccactacacacagaagagcctctccctgtctctgggcaaa

SEQ ID NO: 145 - protein, 236 aa, Artificial Sequence
  Synthetic
MDMRVPAQLLGLLLLWLRGARCDIQMTQSPSSLSASVGDRVTITCQASQDINNHLNWYQQKPGKAPKLLIYDVSNLETGVPSSFSGSGCGTDFTFTISSLQPEDIATYFCQQYDKLPLTFGGGTKVEIEGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 146 - protein, 471 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRNTSINTAYMELSSLRSEDTAVYYCARGGYTSAWRWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 147 - DNA, 33 bp, Artificial Sequence; identical to SEQ ID NO: 107
  Synthetic

SEQ ID NO: 148 - DNA, 21 bp, Artificial Sequence
  Synthetic
gatgtatccaatttggaaaca

SEQ ID NO: 149 - DNA, 27 bp, Artificial Sequence
  Synthetic
caacagtatgataaactcccgctcact

SEQ ID NO: 150 - protein, 11 aa, Artificial Sequence
  Synthetic
QASQDINNHLN

SEQ ID NO: 151 - protein, 7 aa, Artificial Sequence
  Synthetic
DVSNLET

SEQ ID NO: 152 - protein, 9 aa, Artificial Sequence
  Synthetic
QQYDKLPLT

SEQ ID NO: 153 - DNA, 15 bp, Artificial Sequence
  Synthetic
cgttatgatatcaac

SEQ ID NO: 154 - DNA, 51 bp, Artificial Sequence
  Synthetic
tggctgaaccctaatagtggtaacacaggccagacacagaagttccggggc

SEQ ID NO: 155 - DNA, 39 bp, Artificial Sequence
  Synthetic
ggggggtataccagtgcctggagatggtacttcgatctc

SEQ ID NO: 156 - protein, 5 aa, Artificial Sequence
  Synthetic
RYDIN

SEQ ID NO: 157 - protein, 17 aa, Artificial Sequence
  Synthetic
WLNPNSGNTGQTQKFRG

SEQ ID NO: 158 - protein, 13 aa, Artificial Sequence
  Synthetic
GGYTSAWRWYFDL

SEQ ID NO: 159 - DNA, 321 bp, Artificial Sequence
  Synthetic
gacatccagatgacccagtctccatcctccctgtctgcatctgtaggagacagagtcaccatcacttgccaggcgagtcaggacattaacaaccatttaaattggtatcagcagaaaccagggaaagcccctaagctcctgatctacgatgtatccaatttggaaacaggggtcccatcaagtttcagtggaagtggatgtgggacagattttactttcaccatcagcagcctgcagcctgaagatatcgcaacatatttctgtcaacagtatgataaactcccgctcacttttggcggagggaccaaggtggagatcgaa

SEQ ID NO: 160 - DNA, 366 bp, Artificial Sequence
  Synthetic
caggtgcagctggtgcagtctggggctgaggtgaagaagcctggggcctcagtgaaggtctcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccaggaacacctccataaatacagcctacatggagctgagcagcctgagatctgaggacacggccgtgtattactgtgcgagaggggggtataccagtgcctggagatggtacttcgatctctggggccgtggcaccctggtcactgtctcctca

SEQ ID NO: 161 - protein, 107 aa, Artificial Sequence
  Synthetic
DIQMTQSPSSLSASVGDRVTITCQASQDINNHLNWYQQKPGKAPKLLIYDVSNLETGVPSSFSGSGCGTDFTFTISSLQPEDIATYFCQQYDKLPLTFGGGTKVEIE

SEQ ID NO: 162 - protein, 122 aa, Artificial Sequence
  Synthetic
QVQLVQSGAEVKKPGASVKVSCKASGYTFTRYDINWVRQATGQGLEWMGWLNPNSGNTGQTQKFRGRVTMTRNTSINTAYMELSSLRSEDTAVYYCARGGYTSAWRWYFDLWGRGTLVTVSS

SEQ ID NO: 163 - DNA, 708 bp, Artificial Sequence
  Synthetic
atggacatgagggtgcccgctcagctcctggggctcctgctgctgtggctgagaggtgcgcgctgtgacatccagatgacccagtctccatcttccgtgtctgcatctgtaggagacagagtcaccatcacttgtcgggcgagtcagggtattcgcaagtggttagcctggtatcagcagaaaccagggagggcccctaagctcctgatctatgctgcatcccgtttgcaaagtggggtcccatcaaggttcagcggcagtggatctgggacagatttcactctcaccatcagcagcctgcggcctgaagattttgcaacttactattgtcttcaggctcacggtttcccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 164 - DNA, 1395 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacataaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 165 - protein, 236 aa, Artificial Sequence
  Synthetic
MDMRVPAQLLGLLLLWLRGARCDIQMTQSPSSVSASVGDRVTITCRASQGIRKWLAWYQQKPGRAPKLLIYAASRLQSGVPSRFSGSGSGTDFTLTISSLRPEDFATYYCLQAHGFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 166 - protein, 465 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 167 - DNA, 33 bp, Artificial Sequence
  Synthetic
cgggcgagtcagggtattcgcaagtggttagcc

SEQ ID NO: 168 - DNA, 21 bp, Artificial Sequence
  Synthetic
gctgcatcccgtttgcaaagt

SEQ ID NO: 169 - DNA, 27 bp, Artificial Sequence
  Synthetic
cttcaggctcacggtttcccgtggacg

SEQ ID NO: 170 - protein, 11 aa, Artificial Sequence
  Synthetic
RASQGIRKWLA

SEQ ID NO: 171 - protein, 7 aa, Artificial Sequence
  Synthetic
AASRLQS

SEQ ID NO: 172 - protein, 9 aa, Artificial Sequence
  Synthetic
LQAHGFPWT

SEQ ID NO: 173 - DNA, 15 bp, Artificial Sequence
  Synthetic
agctattggatgagc

SEQ ID NO: 174 - DNA, 51 bp, Artificial Sequence
  Synthetic
aacataaagcaagatggaagtgaggaatattatgtggactctgtgaagggc

SEQ ID NO: 175 - DNA, 24 bp, Artificial Sequence
  Synthetic
gactacggtgactcctttgactac

SEQ ID NO: 176 - protein, 5 aa, Artificial Sequence
  Synthetic
SYWMS

SEQ ID NO: 177 - protein, 17 aa, Artificial Sequence
  Synthetic
NIKQDGSEEYYVDSVKG

SEQ ID NO: 178 - protein, 8 aa, Artificial Sequence
  Synthetic
DYGDSFDY

SEQ ID NO: 179 - DNA, 321 bp, Artificial Sequence
  Synthetic
gacatccagatgacccagtctccatcttccgtgtctgcatctgtaggagacagagtcaccatcacttgtcgggcgagtcagggtattcgcaagtggttagcctggtatcagcagaaaccagggagggcccctaagctcctgatctatgctgcatcccgtttgcaaagtggggtcccatcaaggttcagcggcagtggatctgggacagatttcactctcaccatcagcagcctgcggcctgaagattttgcaacttactattgtcttcaggctcacggtttcccgtggacgttcggccaagggaccaaggtggaaatcaaa

SEQ ID NO: 180 - DNA, 351 bp, Artificial Sequence
  Synthetic
gaggtgcagctggtggagtctgggggaggcttggtccagccgggggggtccctgagactctcctgtgcagcctctggattcacctttagtagctattggatgagctgggtccgccaggctccagggaaggggctggagtgggtggccaacataaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtctcctca

SEQ ID NO: 181 - protein, 107 aa, Artificial Sequence
  Synthetic
DIQMTQSPSSVSASVGDRVTITCRASQGIRKWLAWYQQKPGRAPKLLIYAASRLQSGVPSRFSGSGSGTDFTLTISSLRPEDFATYYCLQAHGFPWTFGQGTKVEIK

SEQ ID NO: 182 - protein, 117 aa, Artificial Sequence
  Synthetic
EVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSS

SEQ ID NO: 183 - DNA, 708 bp, Artificial Sequence
  Synthetic
atggacatgagggtgcccgctcagctcctggggctcctgctgctgtggctgagaggtgcgcgctgtgaaatagtgatgacgcagtctccagccaccctgtctgtgtctccaggggaaagagccaccctctcctgcagggccagtcagagtgttagcagcaacttagcctggtatcagcagaaatctggccaggctcccaggctcctcatctatggtgcatccatcagggccactggtatcccagccagggtcagcggcagtgggtctgggacagagttcaccttcactatcagcagcctgcagtctgaagattttgcagtctattactgtcagcagtataagaactggcctctcactctcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 184 - DNA, 1392 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatatactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 185 - protein, 236 aa, Artificial Sequence
  Synthetic
MDMRVPAQLLGLLLLWLRGARCEIVMTQSPATLSVSPGERATLSCRASQSVSSNLAWYQQKSGQAPRLLIYGASIRATGIPARVSGSGSGTEFTFTISSLQSEDFAVYYCQQYKNWPLTLGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 186 - protein, 464 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 187 - DNA, 33 bp, Artificial Sequence
  Synthetic
agggccagtcagagtgttagcagcaacttagcc

SEQ ID NO: 188 - DNA, 21 bp, Artificial Sequence
  Synthetic
ggtgcatccatcagggccact

SEQ ID NO: 189 - DNA, 27 bp, Artificial Sequence
  Synthetic
cagcagtataagaactggcctctcact

SEQ ID NO: 190 - protein, 11 aa, Artificial Sequence
  Synthetic
RASQSVSSNLA

SEQ ID NO: 191 - protein, 7 aa, Artificial Sequence
  Synthetic
GASIRAT

SEQ ID NO: 192 - protein, 9 aa, Artificial Sequence
  Synthetic
QQYKNWPLT

SEQ ID NO: 193 - DNA, 15 bp, Artificial Sequence
  Synthetic
agcaattggatgagc

SEQ ID NO: 194 - DNA, 51 bp, Artificial Sequence
  Synthetic
agcatgaagcaagatggaagtgagatatactatgtggactctgtgaagggc

SEQ ID NO: 195 - DNA, 21 bp, Artificial Sequence
  Synthetic
ggagggtggagatttgagtcc

SEQ ID NO: 196 - protein, 5 aa, Artificial Sequence
  Synthetic
SNWMS

SEQ ID NO: 197 - protein, 17 aa, Artificial Sequence
  Synthetic
SMKQDGSEIYYVDSVKG

SEQ ID NO: 198 - protein, 7 aa, Artificial Sequence
  Synthetic
GGWRFES

SEQ ID NO: 199 - DNA, 321 bp, Artificial Sequence
  Synthetic
gaaatagtgatgacgcagtctccagccaccctgtctgtgtctccaggggaaagagccaccctctcctgcagggccagtcagagtgttagcagcaacttagcctggtatcagcagaaatctggccaggctcccaggctcctcatctatggtgcatccatcagggccactggtatcccagccagggtcagcggcagtgggtctgggacagagttcaccttcactatcagcagcctgcagtctgaagattttgcagtctattactgtcagcagtataagaactggcctctcactctcggcggagggaccaaggtggagatcaaa

SEQ ID NO: 200 - DNA, 348 bp, Artificial Sequence
  Synthetic
gaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatatactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtctcctca

SEQ ID NO: 201 - protein, 107 aa, Artificial Sequence
  Synthetic
EIVMTQSPATLSVSPGERATLSCRASQSVSSNLAWYQQKSGQAPRLLIYGASIRATGIPARVSGSGSGTEFTFTISSLQSEDFAVYYCQQYKNWPLTLGGGTKVEIK

SEQ ID NO: 202 - protein, 116 aa, Artificial Sequence
  Synthetic
EVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSS

SEQ ID NO: 203 - DNA, 711 bp, Artificial Sequence
  Synthetic
atggacatgagggtgcccgctcagctcctggggctcctgctgctgtggctgagaggtgcgcgctgtgaaatagtgatgacgcagtctccagccaccctgtctgtgtctccaggggaaagagccaccctctcctgcagggccagtcagagtgttaacagcaacttagcctggtaccagcagaaacctggccgggctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 204 - DNA, 1401 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtctcagaaatgaggggtagtagtggtagcacatactacgcagactccgtgaagggccggttcaccatctccagagacaattccaagaacacgctgtatctgcaaatgaacagcctgagagtcgaggacacggccatatattactgtgcgaaagaatttagcagcaactccctctttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 205 - protein, 237 aa, Artificial Sequence
  Synthetic
MDMRVPAQLLGLLLLWLRGARCEIVMTQSPATLSVSPGERATLSCRASQSVNSNLAWYQQKPGRAPRLLIYGASTRATGIPARFSGSGSGTEFTLTISSLQSEDFAVYYCQQFYNWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 206 - protein, 467 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 207 - DNA, 33 bp, Artificial Sequence
  Synthetic
agggccagtcagagtgttaacagcaacttagcc

SEQ ID NO: 208 - DNA, 21 bp, Artificial Sequence
  Synthetic
ggtgcatccaccagggccact

SEQ ID NO: 209 - DNA, 30 bp, Artificial Sequence
  Synthetic
cagcagttttataactggcctccgtggacg

SEQ ID NO: 210 - protein, 11 aa, Artificial Sequence
  Synthetic
RASQSVNSNLA

SEQ ID NO: 211 - protein, 7 aa, Artificial Sequence
  Synthetic
GASTRAT

SEQ ID NO: 212 - protein, 10 aa, Artificial Sequence
  Synthetic
QQFYNWPPWT

SEQ ID NO: 213 - DNA, 15 bp, Artificial Sequence
  Synthetic
cgctatgccatgagc

SEQ ID NO: 214 - DNA, 51 bp, Artificial Sequence
  Synthetic
gaaatgaggggtagtagtggtagcacatactacgcagactccgtgaagggc

SEQ ID NO: 215 - DNA, 30 bp, Artificial Sequence
  Synthetic
gaatttagcagcaactccctctttgactac

SEQ ID NO: 216 - protein, 5 aa, Artificial Sequence
  Synthetic
RYAMS

SEQ ID NO: 217 - protein, 17 aa, Artificial Sequence
  Synthetic
EMRGSSGSTYYADSVKG

SEQ ID NO: 218 - protein, 10 aa, Artificial Sequence
  Synthetic
EFSSNSLFDY

SEQ ID NO: 219 - DNA, 324 bp, Artificial Sequence
  Synthetic
gaaatagtgatgacgcagtctccagccaccctgtctgtgtctccaggggaaagagccaccctctcctgcagggccagtcagagtgttaacagcaacttagcctggtaccagcagaaacctggccgggctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgtggacgttcggccaggggaccaaggtggaaatcaaa

SEQ ID NO: 220 - DNA, 357 bp, Artificial Sequence
  Synthetic
gaggtgcagctgttggagtctgggggaggcatggtacagccgggggggtccctgagactctcctgtgcagtctctggattcacctttagtcgctatgccatgagctgggtccgccaggctccagggaaggggctggagtgggtctcagaaatgaggggtagtagtggtagcacatactacgcagactccgtgaagggccggttcaccatctccagagacaattccaagaacacgctgtatctgcaaatgaacagcctgagagtcgaggacacggccatatattactgtgcgaaagaatttagcagcaactccctctttgactactggggccagggaaccctggtcaccgtctcctca

SEQ ID NO: 221 - protein, 108 aa, Artificial Sequence
  Synthetic
EIVMTQSPATLSVSPGERATLSCRASQSVNSNLAWYQQKPGRAPRLLIYGASTRATGIPARFSGSGSGTEFTLTISSLQSEDFAVYYCQQFYNWPPWTFGQGTKVEIK

SEQ ID NO: 222 - protein, 119 aa, Artificial Sequence
  Synthetic
EVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSS

SEQ ID NO: 223 - DNA, 711 bp, Artificial Sequence
  Synthetic
atggacatgagggtgcccgctcagctcctggggctcctgctgctgtggctgagaggtgcgcgctgtgaaatagtgatgacgcagtctccagccatcctgtctgtgtctccaggggaaagagccaccctctcctgcagggccagtcagagtgttagcagcaacttagcctggtaccagcagaaacctggccaggctcccaggctcctcatctatggtgcatccaccagggccacgggtgtcccagccaggttcagtggcggtgggtctgggacagacttcactctcaccatcagcagcctgcagtctgaagattttgcagtttattactgtcagcactgtaagacctggcctccgctcactttcggcggagggaccaaggtggacctcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 224 - DNA, 1401 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtctcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 225 - protein, 237 aa, Artificial Sequence
  Synthetic
MDMRVPAQLLGLLLLWLRGARCEIVMTQSPAILSVSPGERATLSCRASQSVSSNLAWYQQKPGQAPRLLIYGASTRATGVPARFSGGGSGTDFTLTISSLQSEDFAVYYCQHCKTWPPLTFGGGTKVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 226 - protein, 467 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 227 - DNA, 33 bp, Artificial Sequence; identical to SEQ ID NO: 187
  Synthetic

SEQ ID NO: 228 - DNA, 21 bp, Artificial Sequence
  Synthetic
ggtgcatccaccagggccacg

SEQ ID NO: 229 - DNA, 30 bp, Artificial Sequence
  Synthetic
cagcactgtaagacctggcctccgctcact

SEQ ID NO: 230 - protein, 11 aa, Artificial Sequence
  Synthetic
RASQSVSSNLA

SEQ ID NO: 231 - protein, 7 aa, Artificial Sequence
  Synthetic
GASTRAT

SEQ ID NO: 232 - protein, 10 aa, Artificial Sequence
  Synthetic
QHCKTWPPLT

SEQ ID NO: 233 - DNA, 15 bp, Artificial Sequence
  Synthetic
acctatgccatgaac

SEQ ID NO: 234 - DNA, 51 bp, Artificial Sequence
  Synthetic
actgttagtggtagtggtcgtcccacatactacgcagactccgtgaagggc

SEQ ID NO: 235 - DNA, 30 bp, Artificial Sequence
  Synthetic
gcctactacagtaactacctttttgactac

SEQ ID NO: 236 - protein, 5 aa, Artificial Sequence
  Synthetic
TYAMN

SEQ ID NO: 237 - protein, 17 aa, Artificial Sequence
  Synthetic
TVSGSGRPTYYADSVKG

SEQ ID NO: 238 - protein, 10 aa, Artificial Sequence
  Synthetic
AYYSNYLFDY

SEQ ID NO: 239 - DNA, 324 bp, Artificial Sequence
  Synthetic
gaaatagtgatgacgcagtctccagccatcctgtctgtgtctccaggggaaagagccaccctctcctgcagggccagtcagagtgttagcagcaacttagcctggtaccagcagaaacctggccaggctcccaggctcctcatctatggtgcatccaccagggccacgggtgtcccagccaggttcagtggcggtgggtctgggacagacttcactctcaccatcagcagcctgcagtctgaagattttgcagtttattactgtcagcactgtaagacctggcctccgctcactttcggcggagggaccaaggtggacctcaaa

SEQ ID NO: 240 - DNA, 357 bp, Artificial Sequence
  Synthetic
gaggtgcagctgttggagtctgggggaggcttggtacagcctggggggtccctgagactctcctgtgcagcctctggattcacctttagcacctatgccatgaactgggtccgccaggctccagggaaggggctggagtgggtctcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtctcctca

SEQ ID NO: 241 - protein, 108 aa, Artificial Sequence
  Synthetic
EIVMTQSPAILSVSPGERATLSCRASQSVSSNLAWYQQKPGQAPRLLIYGASTRATGVPARFSGGGSGTDFTLTISSLQSEDFAVYYCQHCKTWPPLTFGGGTKVDLK

SEQ ID NO: 242 - protein, 119 aa, Artificial Sequence
  Synthetic
EVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSS

SEQ ID NO: 243 - DNA, 711 bp, Artificial Sequence
  Synthetic
atggacatgagggtgcccgctcagctcctggggctcctgctgctgtggctgagaggtgcgcgctgtgaaatagtgatgacgcagtctccagccaccctgtctgtgtctccaggggaaagagccaccctctcctgcagggccagtcagagtattaacagcaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattatgtggcctccgtggacgttcggcctagggacccaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 244 - DNA, 1401 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtctcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 245 - protein, 237 aa, Artificial Sequence
  Synthetic
MDMRVPAQLLGLLLLWLRGARCEIVMTQSPATLSVSPGERATLSCRASQSINSNLAWYQQKPGQAPRLLIYGAYTRATGIPDRFSGSGSGTEFTLTISSLQSEDFAVYYCQEFIMWPPWTFGLGTQVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 246 - protein, 467 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 247 - DNA, 33 bp, Artificial Sequence
  Synthetic
agggccagtcagagtattaacagcaacttagcc

SEQ ID NO: 248 - DNA, 21 bp, Artificial Sequence
  Synthetic
ggtgcatataccagggccact

SEQ ID NO: 249 - DNA, 30 bp, Artificial Sequence
  Synthetic
caggagtttattatgtggcctccgtggacg

SEQ ID NO: 250 - protein, 11 aa, Artificial Sequence
  Synthetic
RASQSINSNLA

SEQ ID NO: 251 - protein, 7 aa, Artificial Sequence
  Synthetic
GAYTRAT

SEQ ID NO: 252 - protein, 10 aa, Artificial Sequence
  Synthetic
QEFIMWPPWT

SEQ ID NO: 253 - DNA, 15 bp, Artificial Sequence
  Synthetic
gcctatgccatgagc

SEQ ID NO: 254 - DNA, 51 bp, Artificial Sequence
  Synthetic
actattagtggtagtggtagtaccacatactacgcagactccgtgaagggc

SEQ ID NO: 255 - DNA, 30 bp, Artificial Sequence
  Synthetic
gttgctggaagtaactttttctttgaccac

SEQ ID NO: 256 - protein, 5 aa, Artificial Sequence
  Synthetic
AYAMS

SEQ ID NO: 257 - protein, 17 aa, Artificial Sequence
  Synthetic
TISGSGSTTYYADSVKG

SEQ ID NO: 258 - protein, 10 aa, Artificial Sequence
  Synthetic
VAGSNFFFDH

SEQ ID NO: 259 - DNA, 324 bp, Artificial Sequence
  Synthetic
gaaatagtgatgacgcagtctccagccaccctgtctgtgtctccaggggaaagagccaccctctcctgcagggccagtcagagtattaacagcaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattatgtggcctccgtggacgttcggcctagggacccaggtggaaatcaaa

SEQ ID NO: 260 - DNA, 357 bp, Artificial Sequence
  Synthetic
gaggtgcaggtgttggagtctgggggaggcttggtacagcctggggagtccctgagactctcctgtacagcctctggattcacctttaacgcctatgccatgagctgggtccgccaggctccagggaaggggctggagtgggtctcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtctcctca

SEQ ID NO: 261 - protein, 108 aa, Artificial Sequence
  Synthetic
EIVMTQSPATLSVSPGERATLSCRASQSINSNLAWYQQKPGQAPRLLIYGAYTRATGIPDRFSGSGSGTEFTLTISSLQSEDFAVYYCQEFIMWPPWTFGLGTQVEIK

SEQ ID NO: 262 - protein, 119 aa, Artificial Sequence
  Synthetic
EVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSS

SEQ ID NO: 263 - DNA, 708 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaacatcacttgccaggcgagtcaggacattaggaaacatttaaattggtatcagcagaaaccagggaaagcccctaacctcctgatctacgatgcagccaatttggaaacaggggtcccatcaaggttcagtggaagtggttctgggacagcttttactttcaccatcagcagcctgcagcctgaagatattgcaacatattactgtcaacactatgctaatctcccgatcaccttcggccaagggacacgactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgt

SEQ ID NO: 264 - DNA, 1410 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtctcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccaggaacacctccatacacatagcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 265 - protein, 236 aa, Artificial Sequence
  Synthetic
MDMRVPAQLLGLLLLWLRGARCDIQMTQSPSSLSASVGDRVNITCQASQDIRKHLNWYQQKPGKAPNLLIYDAANLETGVPSRFSGSGSGTAFTFTISSLQPEDIATYYCQHYANLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 266 - protein, 470 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRNTSIHIAYMELSSLRSEDTAVYYCARGGYTSSWRWYFDLWGRGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 267 - DNA, 33 bp, Artificial Sequence
  Synthetic
caggcgagtcaggacattaggaaacatttaaat

SEQ ID NO: 268 - DNA, 21 bp, Artificial Sequence
  Synthetic
gatgcagccaatttggaaaca

SEQ ID NO: 269 - DNA, 27 bp, Artificial Sequence
  Synthetic
caacactatgctaatctcccgatcacc

SEQ ID NO: 270 - protein, 11 aa, Artificial Sequence
  Synthetic
QASQDIRKHLN

SEQ ID NO: 271 - protein, 7 aa, Artificial Sequence
  Synthetic
DAANLET

SEQ ID NO: 272 - protein, 9 aa, Artificial Sequence
  Synthetic
QHYANLPIT

SEQ ID NO: 273 - DNA, 15 bp, Artificial Sequence
  Synthetic
agatatgatatcaac

SEQ ID NO: 274 - DNA, 51 bp, Artificial Sequence
  Synthetic
tggatgaaccctaacagtggtaactcaggctctgtacagaagttccggggc

SEQ ID NO: 275 - DNA, 39 bp, Artificial Sequence
  Synthetic
ggcgggtataccagcagctggcggtggtacttcgatctc

SEQ ID NO: 276 - protein, 5 aa, Artificial Sequence
  Synthetic
RYDIN

SEQ ID NO: 277 - protein, 17 aa, Artificial Sequence
  Synthetic
WMNPNSGNSGSVQKFRG

SEQ ID NO: 278 - protein, 13 aa, Artificial Sequence
  Synthetic
GGYTSSWRWYFDL

SEQ ID NO: 279 - DNA, 321 bp, Artificial Sequence
  Synthetic
gacatccagatgacccagtctccatcctccctgtctgcatctgtaggagacagagtcaacatcacttgccaggcgagtcaggacattaggaaacatttaaattggtatcagcagaaaccagggaaagcccctaacctcctgatctacgatgcagccaatttggaaacaggggtcccatcaaggttcagtggaagtggttctgggacagcttttactttcaccatcagcagcctgcagcctgaagatattgcaacatattactgtcaacactatgctaatctcccgatcaccttcggccaagggacacgactggagattaaa

SEQ ID NO: 280 - DNA, 366 bp, Artificial Sequence
  Synthetic
caggtgcagctggtgcagtctggggctgaggtgaagaagcctggggcctcagtgaaggtctcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccaggaacacctccatacacatagcctacatggaactgagcagcctgagatctgaggacacggccgtgtattactgtgcgagaggcgggtataccagcagctggcggtggtacttcgatctctggggccgtggcaccctggtcactgtctcctca

SEQ ID NO: 281 - protein, 107 aa, Artificial Sequence
  Synthetic
DIQMTQSPSSLSASVGDRVNITCQASQDIRKHLNWYQQKPGKAPNLLIYDAANLETGVPSRFSGSGSGTAFTFTISSLQPEDIATYYCQHYANLPITFGQGTRLEIK

SEQ ID NO: 282 - protein, 122 aa, Artificial Sequence
  Synthetic
QVQLVQSGAEVKKPGASVKVSCKASGYTFTRYDINWVRQATGQGLEWMGWMNPNSGNSGSVQKFRGRVTMTRNTSIHIAYMELSSLRSEDTAVYYCARGGYTSSWRWYFDLWGRGTLVTVSS

SEQ ID NO: 283 - DNA, 699 bp, Artificial Sequence
  Synthetic
atggacatgagggtgcccgctcagctcctggggctcctgctgctgtggctgagaggtgcgcgctgttcctatgagctgactcagccaccctcagtgtccgtgtccccaggacagacagccagcatcacctgctctggagataaattgggggagagaaatgtttgctggtatcagttgaagccaggccagtcccctattctggtcatctatcaagataacaagcggccctcagggatccctgagcgattctctggctccaagtctgggaacacagccattctgaccatcagcgggacccaggcaatggatgaggctgactattactgtcaggcgtgggacagaaatgtggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 284 - DNA, 1407 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtctcctgcaaggcttctggatacaccttcaacggctactatatacactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtctcctcagcctccaccaagggcccatcggtcttccccctggcgccctgctccaggagcacctccgagagcacagcggccctgggctgcctggtcaaggactacttccccgaaccggtgacggtgtcgtggaactcaggcgctctgaccagcggcgtgcacaccttcccagctgtcctacagtcctcaggactctactccctcagcagcgtggtgaccgtgccctccagcaacttcggcacccagacctacacctgcaacgtagatcacaagcccagcaacaccaaggtggacaagacagttgagcgcaaatgttgtgtcgagtgcccaccgtgcccagcaccacctgtggcaggaccgtcagtcttcctcttccccccaaaacccaaggacaccctcatgatctcccggacccctgaggtcacgtgcgtggtggtggacgtgagccacgaagaccccgaggtccagttcaactggtacgtggacggcgtggaggtgcataatgccaagacaaagccacgggaggagcagttcaacagcacgttccgtgtggtcagcgtcctcaccgttgtgcaccaggactggctgaacggcaaggagtacaagtgcaaggtctccaacaaaggcctcccagcccccatcgagaaaaccatctccaaaaccaaagggcagccccgagaaccacaggtgtacaccctgcccccatcccgggaggagatgaccaagaaccaggtcagcctgacctgcctggtcaaaggcttctaccccagcgacatcgccgtggagtgggagagcaatgggcagccggagaacaactacaagaccacacctcccatgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggcaaa

SEQ ID NO: 285 - protein, 233 aa, Artificial Sequence
  Synthetic
MDMRVPAQLLGLLLLWLRGARCSYELTQPPSVSVSPGQTASITCSGDKLGERNVCWYQLKPGQSPILVIYQDNKRPSGIPERFSGSKSGNTAILTISGTQAMDEADYYCQAWDRNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 286 - protein, 469 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 287 - DNA, 33 bp, Artificial Sequence
  Synthetic
tctggagataaattgggggagagaaatgtttgc

SEQ ID NO: 288 - DNA, 21 bp, Artificial Sequence
  Synthetic
caagataacaagcggccctca

SEQ ID NO: 289 - DNA, 24 bp, Artificial Sequence
  Synthetic
caggcgtgggacagaaatgtggta

SEQ ID NO: 290 - protein, 11 aa, Artificial Sequence
  Synthetic
SGDKLGERNVC

SEQ ID NO: 291 - protein, 7 aa, Artificial Sequence
  Synthetic
QDNKRPS

SEQ ID NO: 292 - protein, 8 aa, Artificial Sequence
  Synthetic
QAWDRNVV

SEQ ID NO: 293 - DNA, 15 bp, Artificial Sequence
  Synthetic
ggctactatatacac

SEQ ID NO: 294 - DNA, 51 bp, Artificial Sequence
  Synthetic
tggctcaacccaaacagtggtggcgcaaactatgcacagaagtttcagggc

SEQ ID NO: 295 - DNA, 36 bp, Artificial Sequence
  Synthetic
gatcagaggaagaccacggtgactccctttgagtac

SEQ ID NO: 296 - protein, 5 aa, Artificial Sequence
  Synthetic
GYYIH

SEQ ID NO: 297 - protein, 17 aa, Artificial Sequence
  Synthetic
WLNPNSGGANYAQKFQG

SEQ ID NO: 298 - protein, 12 aa, Artificial Sequence
  Synthetic
DQRKTTVTPFEY

SEQ ID NO: 299 - DNA, 315 bp, Artificial Sequence
  Synthetic
tcctatgagctgactcagccaccctcagtgtccgtgtccccaggacagacagccagcatcacctgctctggagataaattgggggagagaaatgtttgctggtatcagttgaagccaggccagtcccctattctggtcatctatcaagataacaagcggccctcagggatccctgagcgattctctggctccaagtctgggaacacagccattctgaccatcagcgggacccaggcaatggatgaggctgactattactgtcaggcgtgggacagaaatgtggtattcggcggagggaccaagctgaccgtccta

SEQ ID NO: 300 - DNA, 363 bp, Artificial Sequence
  Synthetic
caggtgcagctggtgcagtctggggctgaggtgaagaagcctggggcctcagtgaaggtctcctgcaaggcttctggatacaccttcaacggctactatatacactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtctcctca

SEQ ID NO: 301 - protein, 105 aa, Artificial Sequence
  Synthetic
SYELTQPPSVSVSPGQTASITCSGDKLGERNVCWYQLKPGQSPILVIYQDNKRPSGIPERFSGSKSGNTAILTISGTQAMDEADYYCQAWDRNVVFGGGTKLTVL

SEQ ID NO: 302 - protein, 121 aa, Artificial Sequence
  Synthetic
QVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSS

SEQ ID NO: 303 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 304 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacagcaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattatgtggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 305 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 306 - DNA, 714 bp, Artificial Sequence; identical to SEQ ID NO: 304
  Synthetic

SEQ ID NO: 307 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 308 - DNA, 714 bp, Artificial Sequence; identical to SEQ ID NO: 304
  Synthetic

SEQ ID NO: 309 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 310 - DNA, 714 bp, Artificial Sequence; identical to SEQ ID NO: 304
  Synthetic

SEQ ID NO: 311 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 312 - DNA, 714 bp, Artificial Sequence; identical to SEQ ID NO: 304
  Synthetic

SEQ ID NO: 313 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 314 - DNA, 714 bp, Artificial Sequence; identical to SEQ ID NO: 304
  Synthetic

SEQ ID NO: 315 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 316 - DNA, 714 bp, Artificial Sequence; identical to SEQ ID NO: 304
  Synthetic

SEQ ID NO: 317 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 318 - DNA, 714 bp, Artificial Sequence; identical to SEQ ID NO: 304
  Synthetic

SEQ ID NO: 319 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 320 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccatcctgtctgtgtctccaggggaaagagccaccctctcctgcagggccagtcagagtgttagcagcaacttagcctggtaccagcagaaacctggccaggctcccaggctcctcatctatggtgcatccaccagggccacgggtgtcccagccaggttcagtggcggtgggtctgggacagacttcactctcaccatcagcagcctgcagtctgaagattttgcagtttattactgtcagcacttcaagacctggcctccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 321 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 322 - DNA, 714 bp, Artificial Sequence; identical to SEQ ID NO: 320
  Synthetic

SEQ ID NO: 323 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 324 - DNA, 714 bp, Artificial Sequence; identical to SEQ ID NO: 320
  Synthetic

SEQ ID NO: 325 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 326 - DNA, 714 bp, Artificial Sequence; identical to SEQ ID NO: 320
  Synthetic

SEQ ID NO: 327 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 328 - DNA, 714 bp, Artificial Sequence; identical to SEQ ID NO: 320
  Synthetic

SEQ ID NO: 329 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 330 - DNA, 714 bp, Artificial Sequence; identical to SEQ ID NO: 320
  Synthetic

SEQ ID NO: 331 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 332 - DNA, 714 bp, Artificial Sequence; identical to SEQ ID NO: 320
  Synthetic

SEQ ID NO: 333 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 334 - DNA, 714 bp, Artificial Sequence; identical to SEQ ID NO: 320
  Synthetic

SEQ ID NO: 335 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 336 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacagcaacttagcctggtaccagcagaaacctggccgggctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 337 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 338 - DNA, 714 bp, Artificial Sequence; identical to SEQ ID NO: 336
  Synthetic

SEQ ID NO: 339 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 340 - DNA, 714 bp, Artificial Sequence; identical to SEQ ID NO: 336
  Synthetic

SEQ ID NO: 341 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 342 - DNA, 714 bp, Artificial Sequence; identical to SEQ ID NO: 336
  Synthetic

SEQ ID NO: 343 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 344 - DNA, 714 bp, Artificial Sequence; identical to SEQ ID NO: 336
  Synthetic

SEQ ID NO: 345 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 346 - DNA, 714 bp, Artificial Sequence; identical to SEQ ID NO: 336
  Synthetic

SEQ ID NO: 347 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 348 - DNA, 714 bp, Artificial Sequence; identical to SEQ ID NO: 336
  Synthetic

SEQ ID NO: 349 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 350 - DNA, 714 bp, Artificial Sequence; identical to SEQ ID NO: 336
  Synthetic

SEQ ID NO: 351 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 352 - DNA, 711 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttagcagcaacttagcctggtatcagcagaaatctggccaggctcccaggctcctcatctatggtgcatccatcagggccactggtatcccagccagggtcagcggcagtgggtctgggacagagttcaccttcactatcagcagcctgcagtctgaagattttgcagtctattactgtcagcagtataagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 353 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 354 - DNA, 711 bp, Artificial Sequence; identical to SEQ ID NO: 352
  Synthetic

SEQ ID NO: 355 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 356 - DNA, 711 bp, Artificial Sequence; identical to SEQ ID NO: 352
  Synthetic

SEQ ID NO: 357 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 358 - DNA, 711 bp, Artificial Sequence; identical to SEQ ID NO: 352
  Synthetic

SEQ ID NO: 359 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 360 - DNA, 711 bp, Artificial Sequence; identical to SEQ ID NO: 352
  Synthetic

SEQ ID NO: 361 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 362 - DNA, 711 bp, Artificial Sequence; identical to SEQ ID NO: 352
  Synthetic

SEQ ID NO: 363 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 364 - DNA, 711 bp, Artificial Sequence; identical to SEQ ID NO: 352
  Synthetic

SEQ ID NO: 365 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 366 - DNA, 711 bp, Artificial Sequence; identical to SEQ ID NO: 352
  Synthetic

SEQ ID NO: 367 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 368 - DNA, 711 bp, Artificial Sequence
  Synthetic
atggacatgagggtgcccgctcagctcctggggctcctgctgctgtggctgagaggtgcgcgctgtgacatccagatgacccagtctccatcttccgtgtctgcatctgtaggagacagagtcaccatcacttgtcgggcgagtcagggtattcgcaagtggttagcctggtatcagcagaaaccagggagggcccctaagctcctgatctatgctgcatcccgtttgcaaagtggggtcccatcaaggttcagcggcagtggatctgggacagatttcactctcaccatcagcagcctgcggcctgaagattttgcaacttactattgtcttcaggctcacggtttcccgtggacgttcggccaagggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 369 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 370 - DNA, 711 bp, Artificial Sequence; identical to SEQ ID NO: 368
  Synthetic

SEQ ID NO: 371 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 372 - DNA, 711 bp, Artificial Sequence; identical to SEQ ID NO: 368
  Synthetic

SEQ ID NO: 373 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 374 - DNA, 711 bp, Artificial Sequence; identical to SEQ ID NO: 368
  Synthetic

SEQ ID NO: 375 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 376 - DNA, 711 bp, Artificial Sequence; identical to SEQ ID NO: 368
  Synthetic

SEQ ID NO: 377 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 378 - DNA, 711 bp, Artificial Sequence; identical to SEQ ID NO: 368
  Synthetic

SEQ ID NO: 379 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 380 - DNA, 711 bp, Artificial Sequence; identical to SEQ ID NO: 368
  Synthetic

SEQ ID NO: 381 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 382 - DNA, 711 bp, Artificial Sequence; identical to SEQ ID NO: 368
  Synthetic

SEQ ID NO: 383 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 384 - DNA, 711 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcaggacattaacaaccatttaaattggtatcagcagaaaccagggaaagcccctaagctcctgatctacgatgtatccaatttggaaacaggggtcccatcaagtttcagtggaagtggaagcgggacagattttactttcaccatcagcagcctgcagcctgaagatatcgcaacatatttctgtcaacagtatgataaactcccgctcacttttggcggagggaccaaggtggagatcaagcgcacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 385 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 386 - DNA, 711 bp, Artificial Sequence; identical to SEQ ID NO: 384
  Synthetic

SEQ ID NO: 387 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 388 - DNA, 711 bp, Artificial Sequence; identical to SEQ ID NO: 384
  Synthetic

SEQ ID NO: 389 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 390 - DNA, 711 bp, Artificial Sequence; identical to SEQ ID NO: 384
  Synthetic

SEQ ID NO: 391 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 392 - DNA, 711 bp, Artificial Sequence; identical to SEQ ID NO: 384
  Synthetic

SEQ ID NO: 393 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 394 - DNA, 711 bp, Artificial Sequence; identical to SEQ ID NO: 384
  Synthetic

SEQ ID NO: 395 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 396 - DNA, 711 bp, Artificial Sequence; identical to SEQ ID NO: 384
  Synthetic

SEQ ID NO: 397 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 398 - DNA, 711 bp, Artificial Sequence; identical to SEQ ID NO: 384
  Synthetic

SEQ ID NO: 399 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 400 - DNA, 711 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcgggacattagcaagtatttaaattggtatcaacagaaaccagggaaagcccccaaactccagatctacgatgcatccaatttggaaacaggggtcccatcaaggttcagtggaagtggatctgggacagattttactttcaccatcagcagcctgcagcctgaagatattgcaacatattactgtcaacactatgataatatcccgatcacctttggccaggggacaagactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 401 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 402 - DNA, 711 bp, Artificial Sequence; identical to SEQ ID NO: 400
  Synthetic

SEQ ID NO: 403 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 404 - DNA, 711 bp, Artificial Sequence; identical to SEQ ID NO: 400
  Synthetic

SEQ ID NO: 405 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 406 - DNA, 711 bp, Artificial Sequence; identical to SEQ ID NO: 400
  Synthetic

SEQ ID NO: 407 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 408 - DNA, 711 bp, Artificial Sequence; identical to SEQ ID NO: 400
  Synthetic

SEQ ID NO: 409 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 410 - DNA, 711 bp, Artificial Sequence; identical to SEQ ID NO: 400
  Synthetic

SEQ ID NO: 411 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 412 - DNA, 711 bp, Artificial Sequence; identical to SEQ ID NO: 400
  Synthetic

SEQ ID NO: 413 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 414 - DNA, 711 bp, Artificial Sequence; identical to SEQ ID NO: 400
  Synthetic

SEQ ID NO: 415 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 416 - DNA, 711 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcaggacattagcaaacatttaaattggtatcagcagaaaccagggaaagcccctaagctcctgatctacgatacctccaatttggaaacaggggtcccatcaaggttcagtggaagtggatctgggacagattttactttcaccatcagcagcctgcagcctgaagatattgcaacatataactgtcaacagtatgataagctcccgctcactttcggcggagggaccaaggtggagatcaagcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 417 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 418 - DNA, 711 bp, Artificial Sequence; identical to SEQ ID NO: 416
  Synthetic

SEQ ID NO: 419 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 420 - DNA, 711 bp, Artificial Sequence; identical to SEQ ID NO: 416
  Synthetic

SEQ ID NO: 421 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 422 - DNA, 711 bp, Artificial Sequence; identical to SEQ ID NO: 416
  Synthetic

SEQ ID NO: 423 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 424 - DNA, 711 bp, Artificial Sequence; identical to SEQ ID NO: 416
  Synthetic

SEQ ID NO: 425 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 426 - DNA, 711 bp, Artificial Sequence; identical to SEQ ID NO: 416
  Synthetic

SEQ ID NO: 427 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 428 - DNA, 711 bp, Artificial Sequence; identical to SEQ ID NO: 416
  Synthetic

SEQ ID NO: 429 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 430 - DNA, 711 bp, Artificial Sequence; identical to SEQ ID NO: 416
  Synthetic

SEQ ID NO: 431 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 432 - DNA, 711 bp, Artificial Sequence
  Synthetic
atggacatgagggtgcccgctcagctcctggggctcctgctgctgtggctgagaggtgcgcgctgtgacacccagatgacccagtctccatcctccctgtctgcatctgaaggagacagagtcaccatcacttgccaggcgagtcaggacattttcaacgatttaaattggtatcaggagaaaccagggaaagcccctaagctcctgatctaccatgcatccaatttggaaacaggggtcccatcaaggttcagtggaagtggatctgggacagattatactttcaccatcagcagcctgcagcctgaagatattgctacatattactgtcaacaatatggaaatctcccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 433 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 434 - DNA, 711 bp, Artificial Sequence; identical to SEQ ID NO: 432
  Synthetic

SEQ ID NO: 435 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 436 - DNA, 711 bp, Artificial Sequence; identical to SEQ ID NO: 432
  Synthetic

SEQ ID NO: 437 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 438 - DNA, 711 bp, Artificial Sequence; identical to SEQ ID NO: 432
  Synthetic

SEQ ID NO: 439 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 440 - DNA, 711 bp, Artificial Sequence; identical to SEQ ID NO: 432
  Synthetic

SEQ ID NO: 441 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 442 - DNA, 711 bp, Artificial Sequence; identical to SEQ ID NO: 432
  Synthetic

SEQ ID NO: 443 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 444 - DNA, 711 bp, Artificial Sequence; identical to SEQ ID NO: 432
  Synthetic

SEQ ID NO: 445 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 446 - DNA, 711 bp, Artificial Sequence; identical to SEQ ID NO: 432
  Synthetic

SEQ ID NO: 447 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 448 - DNA, 711 bp, Artificial Sequence
  Synthetic
atggacatgagggtgcccgctcagctcctggggctcctgctgctgtggctgagaggtgcgcgctgtgacatccagatgacccagtttccatcttccgtgtctgcatctgtaggagacagagtcaccatcacttgtcgggcgagtcaggggattagcaggtggttagcctggtatcagcagaaacaagggaaagcccctaagctcctgatctatatggtatccagtttgcaaagtggggtcccatcaaggttcagtggcagtggatctgggacagatttcactctcaccatcagcagcctgcagcctgaagattttgcaacttactattgtcagcagtctcacaatttcccgatcaccttcggccaagggacacgactggacattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 449 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 450 - DNA, 711 bp, Artificial Sequence; identical to SEQ ID NO: 448
  Synthetic

SEQ ID NO: 451 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 452 - DNA, 711 bp, Artificial Sequence; identical to SEQ ID NO: 448
  Synthetic

SEQ ID NO: 453 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 454 - DNA, 711 bp, Artificial Sequence; identical to SEQ ID NO: 448
  Synthetic

SEQ ID NO: 455 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 456 - DNA, 711 bp, Artificial Sequence; identical to SEQ ID NO: 448
  Synthetic

SEQ ID NO: 457 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 458 - DNA, 711 bp, Artificial Sequence; identical to SEQ ID NO: 448
  Synthetic

SEQ ID NO: 459 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 460 - DNA, 711 bp, Artificial Sequence; identical to SEQ ID NO: 448
  Synthetic

SEQ ID NO: 461 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 462 - DNA, 711 bp, Artificial Sequence; identical to SEQ ID NO: 448
  Synthetic

SEQ ID NO: 463 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 464 - DNA, 693 bp, Artificial Sequence
  Synthetic
atggcctgggctctgctgctcctcaccctcctcactcagggcacagggtcctgggcctcctatgagctgactcagccaccctcagtgtccgtgtccccaggacagacagccagcatcacctgctctggagataaattgggggagagaaatgttagctggtatcagttgaagccaggccagtcccctattctggtcatctatcaagataacaagcggccctcagggatccctgagcgattctctggctccaagtctgggaacacagccattctgaccatcagcgggacccaggcaatggatgaggctgactattactgtcaggcgtgggacagaaatgtggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 465 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 466 - DNA, 693 bp, Artificial Sequence; identical to SEQ ID NO: 464
  Synthetic

SEQ ID NO: 467 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 468 - DNA, 693 bp, Artificial Sequence; identical to SEQ ID NO: 464
  Synthetic

SEQ ID NO: 469 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 470 - DNA, 693 bp, Artificial Sequence; identical to SEQ ID NO: 464
  Synthetic

SEQ ID NO: 471 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 472 - DNA, 693 bp, Artificial Sequence; identical to SEQ ID NO: 464
  Synthetic

SEQ ID NO: 473 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 474 - DNA, 693 bp, Artificial Sequence; identical to SEQ ID NO: 464
  Synthetic

SEQ ID NO: 475 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 476 - DNA, 693 bp, Artificial Sequence; identical to SEQ ID NO: 464
  Synthetic

SEQ ID NO: 477 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 478 - DNA, 693 bp, Artificial Sequence; identical to SEQ ID NO: 464
  Synthetic

SEQ ID NO: 479 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 480 - DNA, 711 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcaggacattaacaaccatttaaattggtatcagcagaaaccggggaaagcccctaagctcctgatctacggtgcatacactttggaaacaggggtcccatcaaggttcagtggaagtggctctgggacagattttactttcaccatcagcagcctgcagcctgaagatattgctacatattactgtcaacagtatgataagctcccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 481 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 482 - DNA, 711 bp, Artificial Sequence; identical to SEQ ID NO: 480
  Synthetic

SEQ ID NO: 483 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 484 - DNA, 711 bp, Artificial Sequence; identical to SEQ ID NO: 480
  Synthetic

SEQ ID NO: 485 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 486 - DNA, 711 bp, Artificial Sequence; identical to SEQ ID NO: 480
  Synthetic

SEQ ID NO: 487 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 488 - DNA, 711 bp, Artificial Sequence; identical to SEQ ID NO: 480
  Synthetic

SEQ ID NO: 489 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 490 - DNA, 711 bp, Artificial Sequence; identical to SEQ ID NO: 480
  Synthetic

SEQ ID NO: 491 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 492 - DNA, 711 bp, Artificial Sequence; identical to SEQ ID NO: 480
  Synthetic

SEQ ID NO: 493 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 494 - DNA, 711 bp, Artificial Sequence; identical to SEQ ID NO: 480
  Synthetic

SEQ ID NO: 495 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 496 - DNA, 711 bp, Artificial Sequence
  Synthetic
atggacatgagggtgcccgctcagctcctggggctcctgctgctgtggctgagaggtgcgcgctgtgacatccagatgacccagtctccatcttccctgtctgcatctgtaggagacagagtcaccatcacttgccgggcaagtcagagcattagcagcaatttaaattggtatcagcagaaaccagggaaagcccctaagctcctgatctctgctgcatccaatttgcaaagtggggtcccatcaaggttcagtggcagtgaatctgggacagatttcactctcaccatcagcagtctacaatctgaagattttgcaacttactactgtcaacagagtgacagtctcccgctcactttcggcggagggaccaaggtggagatcaagcgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 497 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 498 - DNA, 711 bp, Artificial Sequence; identical to SEQ ID NO: 496
  Synthetic

SEQ ID NO: 499 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 500 - DNA, 711 bp, Artificial Sequence; identical to SEQ ID NO: 496
  Synthetic

SEQ ID NO: 501 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 502 - DNA, 711 bp, Artificial Sequence; identical to SEQ ID NO: 496
  Synthetic

SEQ ID NO: 503 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 504 - DNA, 711 bp, Artificial Sequence; identical to SEQ ID NO: 496
  Synthetic

SEQ ID NO: 505 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 506 - DNA, 711 bp, Artificial Sequence; identical to SEQ ID NO: 496
  Synthetic

SEQ ID NO: 507 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 508 - DNA, 711 bp, Artificial Sequence; identical to SEQ ID NO: 496
  Synthetic

SEQ ID NO: 509 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 510 - DNA, 711 bp, Artificial Sequence; identical to SEQ ID NO: 496
  Synthetic

SEQ ID NO: 511 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 512 - DNA, 711 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcaggacattaggaaacatttaaattggtatcagcagaaaccagggaaagcccctaacctcctgatctacgatgcagccaatttggaaacaggggtcccatcaaggttcagtggaagtggttctgggacagcttttactttcaccatcagcagcctgcagcctgaagatattgcaacatattactgtcaacactatgctaatctcccgatcaccttcggccaagggacacgactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 513 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 514 - DNA, 711 bp, Artificial Sequence; identical to SEQ ID NO: 512
  Synthetic

SEQ ID NO: 515 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 516 - DNA, 711 bp, Artificial Sequence; identical to SEQ ID NO: 512
  Synthetic

SEQ ID NO: 517 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 518 - DNA, 711 bp, Artificial Sequence; identical to SEQ ID NO: 512
  Synthetic

SEQ ID NO: 519 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 520 - DNA, 711 bp, Artificial Sequence; identical to SEQ ID NO: 512
  Synthetic

SEQ ID NO: 521 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 522 - DNA, 711 bp, Artificial Sequence; identical to SEQ ID NO: 512
  Synthetic

SEQ ID NO: 523 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 524 - DNA, 711 bp, Artificial Sequence; identical to SEQ ID NO: 512
  Synthetic

SEQ ID NO: 525 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 526 - DNA, 711 bp, Artificial Sequence; identical to SEQ ID NO: 512
  Synthetic

SEQ ID NO: 527 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 528 - DNA, 714 bp, Artificial Sequence; identical to SEQ ID NO: 304
  Synthetic

SEQ ID NO: 529 - DNA, 1260 bp, Artificial Sequence
  Synthetic
atggacatgagggtgcccgctcagctcctggggctcctgctgctgtggctgagaggtgcgcgctgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcaggacagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 530 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 531 - DNA, 714 bp, Artificial Sequence; identical to SEQ ID NO: 304
  Synthetic

SEQ ID NO: 532 - DNA, 1260 bp, Artificial Sequence
  Synthetic
atggacatgagggtgcccgctcagctcctggggctcctgctgctgtggctgagaggtgcgcgctgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcaggacagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 533 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 534 - DNA, 714 bp, Artificial Sequence; identical to SEQ ID NO: 304
  Synthetic

SEQ ID NO: 535 - DNA, 1260 bp, Artificial Sequence
  Synthetic
atggacatgagggtgcccgctcagctcctggggctcctgctgctgtggctgagaggtgcgcgctgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcaggacagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 536 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 537 - DNA, 714 bp, Artificial Sequence; identical to SEQ ID NO: 304
  Synthetic

SEQ ID NO: 538 - DNA, 1260 bp, Artificial Sequence
  Synthetic
atggacatgagggtgcccgctcagctcctggggctcctgctgctgtggctgagaggtgcgcgctgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcaggacagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 539 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 540 - DNA, 714 bp, Artificial Sequence; identical to SEQ ID NO: 304
  Synthetic

SEQ ID NO: 541 - DNA, 1260 bp, Artificial Sequence
  Synthetic
atggacatgagggtgcccgctcagctcctggggctcctgctgctgtggctgagaggtgcgcgctgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcaggacagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 542 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 543 - DNA, 714 bp, Artificial Sequence; identical to SEQ ID NO: 304
  Synthetic

SEQ ID NO: 544 - DNA, 1260 bp, Artificial Sequence
  Synthetic
atggacatgagggtgcccgctcagctcctggggctcctgctgctgtggctgagaggtgcgcgctgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcaggacagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 545 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 546 - DNA, 714 bp, Artificial Sequence; identical to SEQ ID NO: 304
  Synthetic

SEQ ID NO: 547 - DNA, 1260 bp, Artificial Sequence
  Synthetic
atggacatgagggtgcccgctcagctcctggggctcctgctgctgtggctgagaggtgcgcgctgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcaggacagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 548 - DNA, 1926 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 549 - DNA, 714 bp, Artificial Sequence; identical to SEQ ID NO: 304
  Synthetic

SEQ ID NO: 550 - DNA, 1260 bp, Artificial Sequence
  Synthetic
atggacatgagggtgcccgctcagctcctggggctcctgctgctgtggctgagaggtgcgcgctgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacgacaccacgcctcccgtgctggactccgacggctccttcttcctctatagcgacctcaccgtggacaagagcaggtggcagcaggggaacgtcttctcatgctccgtgatgcatgaggctctgcacaaccactacacgcaggacagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 551 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 552 - DNA, 714 bp, Artificial Sequence; identical to SEQ ID NO: 320
  Synthetic

SEQ ID NO: 553 - DNA, 1260 bp, Artificial Sequence; identical to SEQ ID NO: 529
  Synthetic

SEQ ID NO: 554 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 555 - DNA, 714 bp, Artificial Sequence; identical to SEQ ID NO: 320
  Synthetic

SEQ ID NO: 556 - DNA, 1260 bp, Artificial Sequence; identical to SEQ ID NO: 532
  Synthetic

SEQ ID NO: 557 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 558 - DNA, 714 bp, Artificial Sequence; identical to SEQ ID NO: 320
  Synthetic

SEQ ID NO: 559 - DNA, 1260 bp, Artificial Sequence; identical to SEQ ID NO: 535
  Synthetic

SEQ ID NO: 560 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 561 - DNA, 714 bp, Artificial Sequence; identical to SEQ ID NO: 320
  Synthetic

SEQ ID NO: 562 - DNA, 1260 bp, Artificial Sequence; identical to SEQ ID NO: 538
  Synthetic

SEQ ID NO: 563 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 564 - DNA, 714 bp, Artificial Sequence; identical to SEQ ID NO: 320
  Synthetic

SEQ ID NO: 565 - DNA, 1260 bp, Artificial Sequence; identical to SEQ ID NO: 541
  Synthetic

SEQ ID NO: 566 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 567 - DNA, 714 bp, Artificial Sequence; identical to SEQ ID NO: 320
  Synthetic

SEQ ID NO: 568 - DNA, 1260 bp, Artificial Sequence; identical to SEQ ID NO: 544
  Synthetic

SEQ ID NO: 569 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 570 - DNA, 714 bp, Artificial Sequence; identical to SEQ ID NO: 320
  Synthetic

SEQ ID NO: 571 - DNA, 1260 bp, Artificial Sequence; identical to SEQ ID NO: 547
  Synthetic

SEQ ID NO: 572 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 573 - DNA, 714 bp, Artificial Sequence; identical to SEQ ID NO: 320
  Synthetic

SEQ ID NO: 574 - DNA, 1260 bp, Artificial Sequence; identical to SEQ ID NO: 550
  Synthetic

SEQ ID NO: 575 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 576 - DNA, 714 bp, Artificial Sequence; identical to SEQ ID NO: 336
  Synthetic

SEQ ID NO: 577 - DNA, 1260 bp, Artificial Sequence; identical to SEQ ID NO: 529
  Synthetic

SEQ ID NO: 578 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 579 - DNA, 714 bp, Artificial Sequence; identical to SEQ ID NO: 336
  Synthetic

SEQ ID NO: 580 - DNA, 1260 bp, Artificial Sequence; identical to SEQ ID NO: 532
  Synthetic

SEQ ID NO: 581 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 582 - DNA, 714 bp, Artificial Sequence; identical to SEQ ID NO: 336
  Synthetic

SEQ ID NO: 583 - DNA, 1260 bp, Artificial Sequence; identical to SEQ ID NO: 535
  Synthetic

SEQ ID NO: 584 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 585 - DNA, 714 bp, Artificial Sequence; identical to SEQ ID NO: 336
  Synthetic

SEQ ID NO: 586 - DNA, 1260 bp, Artificial Sequence; identical to SEQ ID NO: 538
  Synthetic

SEQ ID NO: 587 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 588 - DNA, 714 bp, Artificial Sequence; identical to SEQ ID NO: 336
  Synthetic

SEQ ID NO: 589 - DNA, 1260 bp, Artificial Sequence; identical to SEQ ID NO: 541
  Synthetic

SEQ ID NO: 590 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 591 - DNA, 714 bp, Artificial Sequence; identical to SEQ ID NO: 336
  Synthetic

SEQ ID NO: 592 - DNA, 1260 bp, Artificial Sequence; identical to SEQ ID NO: 544
  Synthetic

SEQ ID NO: 593 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 594 - DNA, 714 bp, Artificial Sequence; identical to SEQ ID NO: 336
  Synthetic

SEQ ID NO: 595 - DNA, 1260 bp, Artificial Sequence; identical to SEQ ID NO: 547
  Synthetic

SEQ ID NO: 596 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 597 - DNA, 714 bp, Artificial Sequence; identical to SEQ ID NO: 336
  Synthetic

SEQ ID NO: 598 - DNA, 1260 bp, Artificial Sequence; identical to SEQ ID NO: 550
  Synthetic

SEQ ID NO: 599 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 600 - DNA, 711 bp, Artificial Sequence; identical to SEQ ID NO: 352
  Synthetic

SEQ ID NO: 601 - DNA, 1260 bp, Artificial Sequence; identical to SEQ ID NO: 529
  Synthetic

SEQ ID NO: 602 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 603 - DNA, 711 bp, Artificial Sequence; identical to SEQ ID NO: 352
  Synthetic

SEQ ID NO: 604 - DNA, 1260 bp, Artificial Sequence; identical to SEQ ID NO: 532
  Synthetic

SEQ ID NO: 605 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 606 - DNA, 711 bp, Artificial Sequence; identical to SEQ ID NO: 352
  Synthetic

SEQ ID NO: 607 - DNA, 1260 bp, Artificial Sequence; identical to SEQ ID NO: 535
  Synthetic

SEQ ID NO: 608 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 609 - DNA, 711 bp, Artificial Sequence; identical to SEQ ID NO: 352
  Synthetic

SEQ ID NO: 610 - DNA, 1260 bp, Artificial Sequence; identical to SEQ ID NO: 538
  Synthetic

SEQ ID NO: 611 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 612 - DNA, 711 bp, Artificial Sequence; identical to SEQ ID NO: 352
  Synthetic

SEQ ID NO: 613 - DNA, 1260 bp, Artificial Sequence; identical to SEQ ID NO: 541
  Synthetic

SEQ ID NO: 614 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 615 - DNA, 711 bp, Artificial Sequence; identical to SEQ ID NO: 352
  Synthetic

SEQ ID NO: 616 - DNA, 1260 bp, Artificial Sequence; identical to SEQ ID NO: 544
  Synthetic

SEQ ID NO: 617 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 618 - DNA, 711 bp, Artificial Sequence; identical to SEQ ID NO: 352
  Synthetic

SEQ ID NO: 619 - DNA, 1260 bp, Artificial Sequence; identical to SEQ ID NO: 547
  Synthetic

SEQ ID NO: 620 - DNA, 1917 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 621 - DNA, 711 bp, Artificial Sequence; identical to SEQ ID NO: 352
  Synthetic

SEQ ID NO: 622 - DNA, 1260 bp, Artificial Sequence; identical to SEQ ID NO: 550
  Synthetic

SEQ ID NO: 623 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 624 - DNA, 711 bp, Artificial Sequence; identical to SEQ ID NO: 368
  Synthetic

SEQ ID NO: 625 - DNA, 1260 bp, Artificial Sequence; identical to SEQ ID NO: 529
  Synthetic

SEQ ID NO: 626 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 627 - DNA, 711 bp, Artificial Sequence; identical to SEQ ID NO: 368
  Synthetic

SEQ ID NO: 628 - DNA, 1260 bp, Artificial Sequence; identical to SEQ ID NO: 532
  Synthetic

SEQ ID NO: 629 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 630 - DNA, 711 bp, Artificial Sequence; identical to SEQ ID NO: 368
  Synthetic

SEQ ID NO: 631 - DNA, 1260 bp, Artificial Sequence; identical to SEQ ID NO: 535
  Synthetic

SEQ ID NO: 632 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 633 - DNA, 711 bp, Artificial Sequence; identical to SEQ ID NO: 368
  Synthetic

SEQ ID NO: 634 - DNA, 1260 bp, Artificial Sequence; identical to SEQ ID NO: 538
  Synthetic

SEQ ID NO: 635 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 636 - DNA, 711 bp, Artificial Sequence; identical to SEQ ID NO: 368
  Synthetic

SEQ ID NO: 637 - DNA, 1260 bp, Artificial Sequence; identical to SEQ ID NO: 541
  Synthetic

SEQ ID NO: 638 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 639 - DNA, 711 bp, Artificial Sequence; identical to SEQ ID NO: 368
  Synthetic

SEQ ID NO: 640 - DNA, 1260 bp, Artificial Sequence; identical to SEQ ID NO: 544
  Synthetic

SEQ ID NO: 641 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 642 - DNA, 711 bp, Artificial Sequence; identical to SEQ ID NO: 368
  Synthetic

SEQ ID NO: 643 - DNA, 1260 bp, Artificial Sequence; identical to SEQ ID NO: 547
  Synthetic

SEQ ID NO: 644 - DNA, 1920 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 645 - DNA, 711 bp, Artificial Sequence; identical to SEQ ID NO: 368
  Synthetic

SEQ ID NO: 646 - DNA, 1260 bp, Artificial Sequence; identical to SEQ ID NO: 550
  Synthetic

SEQ ID NO: 647 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 648 - DNA, 711 bp, Artificial Sequence; identical to SEQ ID NO: 384
  Synthetic

SEQ ID NO: 649 - DNA, 1260 bp, Artificial Sequence; identical to SEQ ID NO: 529
  Synthetic

SEQ ID NO: 650 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 651 - DNA, 711 bp, Artificial Sequence; identical to SEQ ID NO: 384
  Synthetic

SEQ ID NO: 652 - DNA, 1260 bp, Artificial Sequence; identical to SEQ ID NO: 532
  Synthetic

SEQ ID NO: 653 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 654 - DNA, 711 bp, Artificial Sequence; identical to SEQ ID NO: 384
  Synthetic

SEQ ID NO: 655 - DNA, 1260 bp, Artificial Sequence; identical to SEQ ID NO: 535
  Synthetic

SEQ ID NO: 656 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 657 - DNA, 711 bp, Artificial Sequence; identical to SEQ ID NO: 384
  Synthetic

SEQ ID NO: 658 - DNA, 1260 bp, Artificial Sequence; identical to SEQ ID NO: 538
  Synthetic

SEQ ID NO: 659 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 660 - DNA, 711 bp, Artificial Sequence; identical to SEQ ID NO: 384
  Synthetic

SEQ ID NO: 661 - DNA, 1260 bp, Artificial Sequence; identical to SEQ ID NO: 541
  Synthetic

SEQ ID NO: 662 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 663 - DNA, 711 bp, Artificial Sequence; identical to SEQ ID NO: 384
  Synthetic

SEQ ID NO: 664 - DNA, 1260 bp, Artificial Sequence; identical to SEQ ID NO: 544
  Synthetic

SEQ ID NO: 665 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 666 - DNA, 711 bp, Artificial Sequence; identical to SEQ ID NO: 384
  Synthetic

SEQ ID NO: 667 - DNA, 1260 bp, Artificial Sequence; identical to SEQ ID NO: 547
  Synthetic

SEQ ID NO: 668 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 669 - DNA, 711 bp, Artificial Sequence; identical to SEQ ID NO: 384
  Synthetic

SEQ ID NO: 670 - DNA, 1260 bp, Artificial Sequence; identical to SEQ ID NO: 550
  Synthetic

SEQ ID NO: 671 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 672 - DNA, 711 bp, Artificial Sequence; identical to SEQ ID NO: 400
  Synthetic

SEQ ID NO: 673 - DNA, 1260 bp, Artificial Sequence; identical to SEQ ID NO: 544
  Synthetic

SEQ ID NO: 674 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 675 - DNA, 711 bp, Artificial Sequence; identical to SEQ ID NO: 400
  Synthetic

SEQ ID NO: 676 - DNA, 1260 bp, Artificial Sequence; identical to SEQ ID NO: 538
  Synthetic

SEQ ID NO: 677 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 678 - DNA, 711 bp, Artificial Sequence; identical to SEQ ID NO: 400
  Synthetic

SEQ ID NO: 679 - DNA, 1260 bp, Artificial Sequence; identical to SEQ ID NO: 529
  Synthetic

SEQ ID NO: 680 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 681 - DNA, 711 bp, Artificial Sequence; identical to SEQ ID NO: 400
  Synthetic

SEQ ID NO: 682 - DNA, 1260 bp, Artificial Sequence; identical to SEQ ID NO: 550
  Synthetic

SEQ ID NO: 683 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 684 - DNA, 711 bp, Artificial Sequence; identical to SEQ ID NO: 400
  Synthetic

SEQ ID NO: 685 - DNA, 1260 bp, Artificial Sequence; identical to SEQ ID NO: 532
  Synthetic

SEQ ID NO: 686 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 687 - DNA, 711 bp, Artificial Sequence; identical to SEQ ID NO: 400
  Synthetic

SEQ ID NO: 688 - DNA, 1260 bp, Artificial Sequence; identical to SEQ ID NO: 547
  Synthetic

SEQ ID NO: 689 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 690 - DNA, 711 bp, Artificial Sequence; identical to SEQ ID NO: 400
  Synthetic

SEQ ID NO: 691 - DNA, 1260 bp, Artificial Sequence; identical to SEQ ID NO: 541
  Synthetic

SEQ ID NO: 692 - DNA, 1938 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 693 - DNA, 711 bp, Artificial Sequence; identical to SEQ ID NO: 400
  Synthetic

SEQ ID NO: 694 - DNA, 1260 bp, Artificial Sequence; identical to SEQ ID NO: 535
  Synthetic

SEQ ID NO: 695 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 696 - DNA, 711 bp, Artificial Sequence; identical to SEQ ID NO: 416
  Synthetic

SEQ ID NO: 697 - DNA, 1260 bp, Artificial Sequence; identical to SEQ ID NO: 529
  Synthetic

SEQ ID NO: 698 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 699 - DNA, 711 bp, Artificial Sequence; identical to SEQ ID NO: 416
  Synthetic

SEQ ID NO: 700 - DNA, 1260 bp, Artificial Sequence; identical to SEQ ID NO: 532
  Synthetic

SEQ ID NO: 701 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 702 - DNA, 711 bp, Artificial Sequence; identical to SEQ ID NO: 416
  Synthetic

SEQ ID NO: 703 - DNA, 1260 bp, Artificial Sequence; identical to SEQ ID NO: 535
  Synthetic

SEQ ID NO: 704 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 705 - DNA, 711 bp, Artificial Sequence; identical to SEQ ID NO: 416
  Synthetic

SEQ ID NO: 706 - DNA, 1260 bp, Artificial Sequence; identical to SEQ ID NO: 538
  Synthetic

SEQ ID NO: 707 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 708 - DNA, 711 bp, Artificial Sequence; identical to SEQ ID NO: 416
  Synthetic

SEQ ID NO: 709 - DNA, 1260 bp, Artificial Sequence; identical to SEQ ID NO: 541
  Synthetic

SEQ ID NO: 710 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 711 - DNA, 711 bp, Artificial Sequence; identical to SEQ ID NO: 416
  Synthetic

SEQ ID NO: 712 - DNA, 1260 bp, Artificial Sequence; identical to SEQ ID NO: 544
  Synthetic

SEQ ID NO: 713 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 714 - DNA, 711 bp, Artificial Sequence; identical to SEQ ID NO: 416
  Synthetic

SEQ ID NO: 715 - DNA, 1260 bp, Artificial Sequence; identical to SEQ ID NO: 547
  Synthetic

SEQ ID NO: 716 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 717 - DNA, 711 bp, Artificial Sequence; identical to SEQ ID NO: 416
  Synthetic

SEQ ID NO: 718 - DNA, 1260 bp, Artificial Sequence; identical to SEQ ID NO: 550
  Synthetic

SEQ ID NO: 719 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 720 - DNA, 711 bp, Artificial Sequence; identical to SEQ ID NO: 432
  Synthetic

SEQ ID NO: 721 - DNA, 1260 bp, Artificial Sequence; identical to SEQ ID NO: 529
  Synthetic

SEQ ID NO: 722 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 723 - DNA, 711 bp, Artificial Sequence; identical to SEQ ID NO: 432
  Synthetic

SEQ ID NO: 724 - DNA, 1260 bp, Artificial Sequence; identical to SEQ ID NO: 532
  Synthetic

SEQ ID NO: 725 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 726 - DNA, 711 bp, Artificial Sequence; identical to SEQ ID NO: 432
  Synthetic

SEQ ID NO: 727 - DNA, 1260 bp, Artificial Sequence; identical to SEQ ID NO: 535
  Synthetic

SEQ ID NO: 728 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 729 - DNA, 711 bp, Artificial Sequence; identical to SEQ ID NO: 432
  Synthetic

SEQ ID NO: 730 - DNA, 1260 bp, Artificial Sequence; identical to SEQ ID NO: 538
  Synthetic

SEQ ID NO: 731 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 732 - DNA, 711 bp, Artificial Sequence; identical to SEQ ID NO: 432
  Synthetic

SEQ ID NO: 733 - DNA, 1260 bp, Artificial Sequence; identical to SEQ ID NO: 541
  Synthetic

SEQ ID NO: 734 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 735 - DNA, 711 bp, Artificial Sequence; identical to SEQ ID NO: 432
  Synthetic

SEQ ID NO: 736 - DNA, 1260 bp, Artificial Sequence; identical to SEQ ID NO: 544
  Synthetic

SEQ ID NO: 737 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 738 - DNA, 711 bp, Artificial Sequence; identical to SEQ ID NO: 432
  Synthetic

SEQ ID NO: 739 - DNA, 1260 bp, Artificial Sequence; identical to SEQ ID NO: 547
  Synthetic

SEQ ID NO: 740 - DNA, 1941 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 741 - DNA, 711 bp, Artificial Sequence; identical to SEQ ID NO: 432
  Synthetic

SEQ ID NO: 742 - DNA, 1260 bp, Artificial Sequence; identical to SEQ ID NO: 550
  Synthetic

SEQ ID NO: 743 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 744 - DNA, 711 bp, Artificial Sequence; identical to SEQ ID NO: 448
  Synthetic

SEQ ID NO: 745 - DNA, 1260 bp, Artificial Sequence; identical to SEQ ID NO: 529
  Synthetic

SEQ ID NO: 746 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 747 - DNA, 711 bp, Artificial Sequence; identical to SEQ ID NO: 448
  Synthetic

SEQ ID NO: 748 - DNA, 1260 bp, Artificial Sequence; identical to SEQ ID NO: 532
  Synthetic

SEQ ID NO: 749 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 750 - DNA, 711 bp, Artificial Sequence; identical to SEQ ID NO: 448
  Synthetic

SEQ ID NO: 751 - DNA, 1260 bp, Artificial Sequence; identical to SEQ ID NO: 535
  Synthetic

SEQ ID NO: 752 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 753 - DNA, 711 bp, Artificial Sequence; identical to SEQ ID NO: 448
  Synthetic

SEQ ID NO: 754 - DNA, 1260 bp, Artificial Sequence; identical to SEQ ID NO: 538
  Synthetic

SEQ ID NO: 755 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 756 - DNA, 711 bp, Artificial Sequence; identical to SEQ ID NO: 448
  Synthetic

SEQ ID NO: 757 - DNA, 1260 bp, Artificial Sequence; identical to SEQ ID NO: 541
  Synthetic

SEQ ID NO: 758 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 759 - DNA, 711 bp, Artificial Sequence; identical to SEQ ID NO: 448
  Synthetic

SEQ ID NO: 760 - DNA, 1260 bp, Artificial Sequence; identical to SEQ ID NO: 544
  Synthetic

SEQ ID NO: 761 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 762 - DNA, 711 bp, Artificial Sequence; identical to SEQ ID NO: 448
  Synthetic

SEQ ID NO: 763 - DNA, 1260 bp, Artificial Sequence; identical to SEQ ID NO: 547
  Synthetic

SEQ ID NO: 764 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 765 - DNA, 711 bp, Artificial Sequence; identical to SEQ ID NO: 448
  Synthetic

SEQ ID NO: 766 - DNA, 1260 bp, Artificial Sequence; identical to SEQ ID NO: 550
  Synthetic

SEQ ID NO: 767 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 768 - DNA, 693 bp, Artificial Sequence; identical to SEQ ID NO: 464
  Synthetic

SEQ ID NO: 769 - DNA, 1260 bp, Artificial Sequence; identical to SEQ ID NO: 529
  Synthetic

SEQ ID NO: 770 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 771 - DNA, 693 bp, Artificial Sequence; identical to SEQ ID NO: 464
  Synthetic

SEQ ID NO: 772 - DNA, 1260 bp, Artificial Sequence; identical to SEQ ID NO: 532
  Synthetic

SEQ ID NO: 773 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 774 - DNA, 693 bp, Artificial Sequence; identical to SEQ ID NO: 464
  Synthetic

SEQ ID NO: 775 - DNA, 1260 bp, Artificial Sequence; identical to SEQ ID NO: 535
  Synthetic

SEQ ID NO: 776 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 777 - DNA, 693 bp, Artificial Sequence; identical to SEQ ID NO: 464
  Synthetic

SEQ ID NO: 778 - DNA, 1260 bp, Artificial Sequence; identical to SEQ ID NO: 538
  Synthetic

SEQ ID NO: 779 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 780 - DNA, 693 bp, Artificial Sequence; identical to SEQ ID NO: 464
  Synthetic

SEQ ID NO: 781 - DNA, 1260 bp, Artificial Sequence; identical to SEQ ID NO: 541
  Synthetic

SEQ ID NO: 782 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 783 - DNA, 693 bp, Artificial Sequence; identical to SEQ ID NO: 464
  Synthetic

SEQ ID NO: 784 - DNA, 1260 bp, Artificial Sequence; identical to SEQ ID NO: 544
  Synthetic

SEQ ID NO: 785 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 786 - DNA, 693 bp, Artificial Sequence; identical to SEQ ID NO: 464
  Synthetic

SEQ ID NO: 787 - DNA, 1260 bp, Artificial Sequence; identical to SEQ ID NO: 547
  Synthetic

SEQ ID NO: 788 - DNA, 1932 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 789 - DNA, 693 bp, Artificial Sequence; identical to SEQ ID NO: 464
  Synthetic

SEQ ID NO: 790 - DNA, 1260 bp, Artificial Sequence; identical to SEQ ID NO: 550
  Synthetic

SEQ ID NO: 791 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 792 - DNA, 711 bp, Artificial Sequence; identical to SEQ ID NO: 480
  Synthetic

SEQ ID NO: 793 - DNA, 1260 bp, Artificial Sequence; identical to SEQ ID NO: 529
  Synthetic

SEQ ID NO: 794 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 795 - DNA, 711 bp, Artificial Sequence; identical to SEQ ID NO: 480
  Synthetic

SEQ ID NO: 796 - DNA, 1260 bp, Artificial Sequence; identical to SEQ ID NO: 532
  Synthetic

SEQ ID NO: 797 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 798 - DNA, 711 bp, Artificial Sequence; identical to SEQ ID NO: 480
  Synthetic

SEQ ID NO: 799 - DNA, 1260 bp, Artificial Sequence; identical to SEQ ID NO: 535
  Synthetic

SEQ ID NO: 800 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 801 - DNA, 711 bp, Artificial Sequence; identical to SEQ ID NO: 480
  Synthetic

SEQ ID NO: 802 - DNA, 1260 bp, Artificial Sequence; identical to SEQ ID NO: 538
  Synthetic

SEQ ID NO: 803 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 804 - DNA, 711 bp, Artificial Sequence; identical to SEQ ID NO: 480
  Synthetic

SEQ ID NO: 805 - DNA, 1260 bp, Artificial Sequence; identical to SEQ ID NO: 541
  Synthetic

SEQ ID NO: 806 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 807 - DNA, 711 bp, Artificial Sequence; identical to SEQ ID NO: 480
  Synthetic

SEQ ID NO: 808 - DNA, 1260 bp, Artificial Sequence; identical to SEQ ID NO: 544
  Synthetic

SEQ ID NO: 809 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 810 - DNA, 711 bp, Artificial Sequence; identical to SEQ ID NO: 480
  Synthetic

SEQ ID NO: 811 - DNA, 1260 bp, Artificial Sequence; identical to SEQ ID NO: 547
  Synthetic

SEQ ID NO: 812 - DNA, 1935 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 813 - DNA, 711 bp, Artificial Sequence; identical to SEQ ID NO: 480
  Synthetic

SEQ ID NO: 814 - DNA, 1260 bp, Artificial Sequence; identical to SEQ ID NO: 550
  Synthetic

SEQ ID NO: 815 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 816 - DNA, 711 bp, Artificial Sequence; identical to SEQ ID NO: 496
  Synthetic

SEQ ID NO: 817 - DNA, 1260 bp, Artificial Sequence; identical to SEQ ID NO: 529
  Synthetic

SEQ ID NO: 818 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 819 - DNA, 711 bp, Artificial Sequence; identical to SEQ ID NO: 496
  Synthetic

SEQ ID NO: 820 - DNA, 1260 bp, Artificial Sequence; identical to SEQ ID NO: 532
  Synthetic

SEQ ID NO: 821 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 822 - DNA, 711 bp, Artificial Sequence; identical to SEQ ID NO: 496
  Synthetic

SEQ ID NO: 823 - DNA, 1260 bp, Artificial Sequence; identical to SEQ ID NO: 535
  Synthetic

SEQ ID NO: 824 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 825 - DNA, 711 bp, Artificial Sequence; identical to SEQ ID NO: 496
  Synthetic

SEQ ID NO: 826 - DNA, 1260 bp, Artificial Sequence; identical to SEQ ID NO: 538
  Synthetic

SEQ ID NO: 827 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 828 - DNA, 711 bp, Artificial Sequence; identical to SEQ ID NO: 496
  Synthetic

SEQ ID NO: 829 - DNA, 1260 bp, Artificial Sequence; identical to SEQ ID NO: 541
  Synthetic

SEQ ID NO: 830 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 831 - DNA, 711 bp, Artificial Sequence; identical to SEQ ID NO: 496
  Synthetic

SEQ ID NO: 832 - DNA, 1260 bp, Artificial Sequence; identical to SEQ ID NO: 544
  Synthetic

SEQ ID NO: 833 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 834 - DNA, 711 bp, Artificial Sequence; identical to SEQ ID NO: 496
  Synthetic

SEQ ID NO: 835 - DNA, 1260 bp, Artificial Sequence; identical to SEQ ID NO: 547
  Synthetic

SEQ ID NO: 836 - DNA, 1926 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 837 - DNA, 711 bp, Artificial Sequence; identical to SEQ ID NO: 496
  Synthetic

SEQ ID NO: 838 - DNA, 1260 bp, Artificial Sequence; identical to SEQ ID NO: 550
  Synthetic

SEQ ID NO: 839 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcttgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 840 - DNA, 711 bp, Artificial Sequence; identical to SEQ ID NO: 512
  Synthetic

SEQ ID NO: 841 - DNA, 1260 bp, Artificial Sequence; identical to SEQ ID NO: 529
  Synthetic

SEQ ID NO: 842 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacttagctatgtccgaattcgacatcttcatcaactacatcgaagcttacatgaccatgaaaatccgtaactag

SEQ ID NO: 843 - DNA, 711 bp, Artificial Sequence; identical to SEQ ID NO: 512
  Synthetic

SEQ ID NO: 844 - DNA, 1260 bp, Artificial Sequence; identical to SEQ ID NO: 532
  Synthetic

SEQ ID NO: 845 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacgacgctatgtccgaattcgacatcttcatcaactacatcgaagcttacatgaccatgaaaatccgtaactag

SEQ ID NO: 846 - DNA, 711 bp, Artificial Sequence; identical to SEQ ID NO: 512
  Synthetic

SEQ ID NO: 847 - DNA, 1260 bp, Artificial Sequence; identical to SEQ ID NO: 535
  Synthetic

SEQ ID NO: 848 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaaggccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 849 - DNA, 711 bp, Artificial Sequence; identical to SEQ ID NO: 512
  Synthetic

SEQ ID NO: 850 - DNA, 1260 bp, Artificial Sequence; identical to SEQ ID NO: 538
  Synthetic

SEQ ID NO: 851 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccggatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 852 - DNA, 711 bp, Artificial Sequence; identical to SEQ ID NO: 512
  Synthetic

SEQ ID NO: 853 - DNA, 1260 bp, Artificial Sequence; identical to SEQ ID NO: 541
  Synthetic

SEQ ID NO: 854 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttccagatgaaagaccagctggacaacaagctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 855 - DNA, 711 bp, Artificial Sequence; identical to SEQ ID NO: 512
  Synthetic

SEQ ID NO: 856 - DNA, 1260 bp, Artificial Sequence; identical to SEQ ID NO: 544
  Synthetic

SEQ ID NO: 857 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttgacaccttcttccagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 858 - DNA, 711 bp, Artificial Sequence; identical to SEQ ID NO: 512
  Synthetic

SEQ ID NO: 859 - DNA, 1260 bp, Artificial Sequence; identical to SEQ ID NO: 547
  Synthetic

SEQ ID NO: 860 - DNA, 1935 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccggaaggagatgaccaagaaccaggtcagcctgacctgcctggtcaaaggcttctatcccagcgacatcgccgtggagtgggagagcaatgggcagccggagaacaactacaagaccacgcctcccgtgctgaagtccgacggctccttcttcctctatagcaagctcaccgtggacaagagcaggtggcagcaggggaacgtcttctcatgctccgtgatgcatgaggctctgcacaaccactacacgcagaagagcctctccctgtctcccgggggaggcggtggatcctctccaggtcaaggtactcaatccgaaaactcctgcacccacttcccgggtaacctgccgaacatgctgcgtgacctgcgtgacgctttctcccgtgttaaaaccttcttcgagatgaaagaccagctggacaacctgctgctgaaagaatccctgctggaagacttcaaaggttacctgggttgtcaggctctgtccgaaatgatccagttctacctggaagaagttatgccgcaggctgaaaaccaggacccggacatcaaagctcacgttaactccctgggtgaaaacctgaaaaccctgcgtctgcgtctgcgccgttgccatcgattcctgccgtgcgaaaacggtggcggttctggtggtaaatccaaagctgttgaacaggttaaaaacgctttcaacaaactgcaggaaaaaggtatctacaaagctatgtccgaattcgacatcttcatcaactacatcgaagcttacatgaccatgaaaatccgtaactag

SEQ ID NO: 861 - DNA, 711 bp, Artificial Sequence; identical to SEQ ID NO: 512
  Synthetic

SEQ ID NO: 862 - DNA, 1260 bp, Artificial Sequence; identical to SEQ ID NO: 550
  Synthetic

SEQ ID NO: 863 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 864 - protein, 237 aa, Artificial Sequence
  Synthetic
MDMRVPAQLLGLLLLWLRGARCEIVMTQSPATLSVSPGERATLSCRASQSINSNLAWYQQKPGQAPRLLIYGAYTRATGIPDRFSGSGSGTEFTLTISSLQSEDFAVYYCQEFIMWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 865 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 866 - protein, 237 aa, Artificial Sequence; identical to SEQ ID NO: 864
  Synthetic

SEQ ID NO: 867 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 868 - protein, 237 aa, Artificial Sequence; identical to SEQ ID NO: 864
  Synthetic

SEQ ID NO: 869 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 870 - protein, 237 aa, Artificial Sequence; identical to SEQ ID NO: 864
  Synthetic

SEQ ID NO: 871 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 872 - protein, 237 aa, Artificial Sequence; identical to SEQ ID NO: 864
  Synthetic

SEQ ID NO: 873 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 874 - protein, 237 aa, Artificial Sequence; identical to SEQ ID NO: 864
  Synthetic

SEQ ID NO: 875 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 876 - protein, 237 aa, Artificial Sequence; identical to SEQ ID NO: 864
  Synthetic

SEQ ID NO: 877 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 878 - protein, 237 aa, Artificial Sequence; identical to SEQ ID NO: 864
  Synthetic

SEQ ID NO: 879 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 880 - protein, 237 aa, Artificial Sequence
  Synthetic
MDMRVPAQLLGLLLLWLRGARCEIVMTQSPAILSVSPGERATLSCRASQSVSSNLAWYQQKPGQAPRLLIYGASTRATGVPARFSGGGSGTDFTLTISSLQSEDFAVYYCQHFKTWPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 881 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 882 - protein, 237 aa, Artificial Sequence; identical to SEQ ID NO: 880
  Synthetic

SEQ ID NO: 883 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 884 - protein, 237 aa, Artificial Sequence; identical to SEQ ID NO: 880
  Synthetic

SEQ ID NO: 885 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 886 - protein, 237 aa, Artificial Sequence; identical to SEQ ID NO: 880
  Synthetic

SEQ ID NO: 887 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 888 - protein, 237 aa, Artificial Sequence; identical to SEQ ID NO: 880
  Synthetic

SEQ ID NO: 889 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 890 - protein, 237 aa, Artificial Sequence; identical to SEQ ID NO: 880
  Synthetic

SEQ ID NO: 891 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 892 - protein, 237 aa, Artificial Sequence; identical to SEQ ID NO: 880
  Synthetic

SEQ ID NO: 893 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 894 - protein, 237 aa, Artificial Sequence; identical to SEQ ID NO: 880
  Synthetic

SEQ ID NO: 895 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 896 - protein, 237 aa, Artificial Sequence; identical to SEQ ID NO: 205
  Synthetic

SEQ ID NO: 897 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 898 - protein, 237 aa, Artificial Sequence; identical to SEQ ID NO: 205
  Synthetic

SEQ ID NO: 899 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 900 - protein, 237 aa, Artificial Sequence; identical to SEQ ID NO: 205
  Synthetic

SEQ ID NO: 901 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 902 - protein, 237 aa, Artificial Sequence; identical to SEQ ID NO: 205
  Synthetic

SEQ ID NO: 903 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 904 - protein, 237 aa, Artificial Sequence; identical to SEQ ID NO: 205
  Synthetic

SEQ ID NO: 905 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 906 - protein, 237 aa, Artificial Sequence; identical to SEQ ID NO: 205
  Synthetic

SEQ ID NO: 907 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 908 - protein, 237 aa, Artificial Sequence; identical to SEQ ID NO: 205
  Synthetic

SEQ ID NO: 909 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 910 - protein, 237 aa, Artificial Sequence; identical to SEQ ID NO: 205
  Synthetic

SEQ ID NO: 911 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 912 - protein, 236 aa, Artificial Sequence
  Synthetic
MDMRVPAQLLGLLLLWLRGARCEIVMTQSPATLSVSPGERATLSCRASQSVSSNLAWYQQKSGQAPRLLIYGASIRATGIPARVSGSGSGTEFTFTISSLQSEDFAVYYCQQYKNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 913 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 914 - protein, 236 aa, Artificial Sequence; identical to SEQ ID NO: 912
  Synthetic

SEQ ID NO: 915 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 916 - protein, 236 aa, Artificial Sequence; identical to SEQ ID NO: 912
  Synthetic

SEQ ID NO: 917 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 918 - protein, 236 aa, Artificial Sequence; identical to SEQ ID NO: 912
  Synthetic

SEQ ID NO: 919 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 920 - protein, 236 aa, Artificial Sequence; identical to SEQ ID NO: 912
  Synthetic

SEQ ID NO: 921 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 922 - protein, 236 aa, Artificial Sequence; identical to SEQ ID NO: 912
  Synthetic

SEQ ID NO: 923 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 924 - protein, 236 aa, Artificial Sequence; identical to SEQ ID NO: 912
  Synthetic

SEQ ID NO: 925 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 926 - protein, 236 aa, Artificial Sequence; identical to SEQ ID NO: 912
  Synthetic

SEQ ID NO: 927 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 928 - protein, 236 aa, Artificial Sequence; identical to SEQ ID NO: 165
  Synthetic

SEQ ID NO: 929 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 930 - protein, 236 aa, Artificial Sequence; identical to SEQ ID NO: 165
  Synthetic

SEQ ID NO: 931 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 932 - protein, 236 aa, Artificial Sequence; identical to SEQ ID NO: 165
  Synthetic

SEQ ID NO: 933 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 934 - protein, 236 aa, Artificial Sequence; identical to SEQ ID NO: 165
  Synthetic

SEQ ID NO: 935 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 936 - protein, 236 aa, Artificial Sequence; identical to SEQ ID NO: 165
  Synthetic

SEQ ID NO: 937 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 938 - protein, 236 aa, Artificial Sequence; identical to SEQ ID NO: 165
  Synthetic

SEQ ID NO: 939 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 940 - protein, 236 aa, Artificial Sequence; identical to SEQ ID NO: 165
  Synthetic

SEQ ID NO: 941 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 942 - protein, 236 aa, Artificial Sequence; identical to SEQ ID NO: 165
  Synthetic

SEQ ID NO: 943 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 944 - protein, 236 aa, Artificial Sequence
  Synthetic
MDMRVPAQLLGLLLLWLRGARCDIQMTQSPSSLSASVGDRVTITCQASQDINNHLNWYQQKPGKAPKLLIYDVSNLETGVPSSFSGSGSGTDFTFTISSLQPEDIATYFCQQYDKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 945 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 946 - protein, 236 aa, Artificial Sequence; identical to SEQ ID NO: 944
  Synthetic

SEQ ID NO: 947 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 948 - protein, 236 aa, Artificial Sequence; identical to SEQ ID NO: 944
  Synthetic

SEQ ID NO: 949 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 950 - protein, 236 aa, Artificial Sequence; identical to SEQ ID NO: 944
  Synthetic

SEQ ID NO: 951 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 952 - protein, 236 aa, Artificial Sequence; identical to SEQ ID NO: 944
  Synthetic

SEQ ID NO: 953 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 954 - protein, 236 aa, Artificial Sequence; identical to SEQ ID NO: 944
  Synthetic

SEQ ID NO: 955 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 956 - protein, 236 aa, Artificial Sequence; identical to SEQ ID NO: 944
  Synthetic

SEQ ID NO: 957 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 958 - protein, 236 aa, Artificial Sequence; identical to SEQ ID NO: 944
  Synthetic

SEQ ID NO: 959 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 960 - protein, 236 aa, Artificial Sequence; identical to SEQ ID NO: 85
  Synthetic

SEQ ID NO: 961 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 962 - protein, 236 aa, Artificial Sequence; identical to SEQ ID NO: 85
  Synthetic

SEQ ID NO: 963 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 964 - protein, 236 aa, Artificial Sequence; identical to SEQ ID NO: 85
  Synthetic

SEQ ID NO: 965 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 966 - protein, 236 aa, Artificial Sequence; identical to SEQ ID NO: 85
  Synthetic

SEQ ID NO: 967 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 968 - protein, 236 aa, Artificial Sequence; identical to SEQ ID NO: 85
  Synthetic

SEQ ID NO: 969 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 970 - protein, 236 aa, Artificial Sequence; identical to SEQ ID NO: 85
  Synthetic

SEQ ID NO: 971 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 972 - protein, 236 aa, Artificial Sequence; identical to SEQ ID NO: 85
  Synthetic

SEQ ID NO: 973 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 974 - protein, 236 aa, Artificial Sequence; identical to SEQ ID NO: 85
  Synthetic

SEQ ID NO: 975 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 976 - protein, 236 aa, Artificial Sequence; identical to SEQ ID NO: 65
  Synthetic

SEQ ID NO: 977 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 978 - protein, 236 aa, Artificial Sequence; identical to SEQ ID NO: 65
  Synthetic

SEQ ID NO: 979 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 980 - protein, 236 aa, Artificial Sequence; identical to SEQ ID NO: 65
  Synthetic

SEQ ID NO: 981 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 982 - protein, 236 aa, Artificial Sequence; identical to SEQ ID NO: 65
  Synthetic

SEQ ID NO: 983 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 984 - protein, 236 aa, Artificial Sequence; identical to SEQ ID NO: 65
  Synthetic

SEQ ID NO: 985 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 986 - protein, 236 aa, Artificial Sequence; identical to SEQ ID NO: 65
  Synthetic

SEQ ID NO: 987 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 988 - protein, 236 aa, Artificial Sequence; identical to SEQ ID NO: 65
  Synthetic

SEQ ID NO: 989 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 990 - protein, 236 aa, Artificial Sequence; identical to SEQ ID NO: 65
  Synthetic

SEQ ID NO: 991 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 992 - protein, 236 aa, Artificial Sequence; identical to SEQ ID NO: 45
  Synthetic

SEQ ID NO: 993 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 994 - protein, 236 aa, Artificial Sequence; identical to SEQ ID NO: 45
  Synthetic

SEQ ID NO: 995 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 996 - protein, 236 aa, Artificial Sequence; identical to SEQ ID NO: 45
  Synthetic

SEQ ID NO: 997 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 998 - protein, 236 aa, Artificial Sequence; identical to SEQ ID NO: 45
  Synthetic

SEQ ID NO: 999 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1000 - protein, 236 aa, Artificial Sequence; identical to SEQ ID NO: 45
  Synthetic

SEQ ID NO: 1001 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1002 - protein, 236 aa, Artificial Sequence; identical to SEQ ID NO: 45
  Synthetic

SEQ ID NO: 1003 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1004 - protein, 236 aa, Artificial Sequence; identical to SEQ ID NO: 45
  Synthetic

SEQ ID NO: 1005 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1006 - protein, 236 aa, Artificial Sequence; identical to SEQ ID NO: 45
  Synthetic

SEQ ID NO: 1007 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1008 - protein, 236 aa, Artificial Sequence; identical to SEQ ID NO: 25
  Synthetic

SEQ ID NO: 1009 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1010 - protein, 236 aa, Artificial Sequence; identical to SEQ ID NO: 25
  Synthetic

SEQ ID NO: 1011 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1012 - protein, 236 aa, Artificial Sequence; identical to SEQ ID NO: 25
  Synthetic

SEQ ID NO: 1013 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1014 - protein, 236 aa, Artificial Sequence; identical to SEQ ID NO: 25
  Synthetic

SEQ ID NO: 1015 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1016 - protein, 236 aa, Artificial Sequence; identical to SEQ ID NO: 25
  Synthetic

SEQ ID NO: 1017 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1018 - protein, 236 aa, Artificial Sequence; identical to SEQ ID NO: 25
  Synthetic

SEQ ID NO: 1019 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1020 - protein, 236 aa, Artificial Sequence; identical to SEQ ID NO: 25
  Synthetic

SEQ ID NO: 1021 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1022 - protein, 236 aa, Artificial Sequence; identical to SEQ ID NO: 25
  Synthetic

SEQ ID NO: 1023 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1024 - protein, 230 aa, Artificial Sequence
  Synthetic
MAWALLLLTLLTQGTGSWASYELTQPPSVSVSPGQTASITCSGDKLGERNVSWYQLKPGQSPILVIYQDNKRPSGIPERFSGSKSGNTAILTISGTQAMDEADYYCQAWDRNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1025 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1026 - protein, 230 aa, Artificial Sequence; identical to SEQ ID NO: 1024
  Synthetic

SEQ ID NO: 1027 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1028 - protein, 230 aa, Artificial Sequence; identical to SEQ ID NO: 1024
  Synthetic

SEQ ID NO: 1029 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1030 - protein, 230 aa, Artificial Sequence; identical to SEQ ID NO: 1024
  Synthetic

SEQ ID NO: 1031 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1032 - protein, 230 aa, Artificial Sequence; identical to SEQ ID NO: 1024
  Synthetic

SEQ ID NO: 1033 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1034 - protein, 230 aa, Artificial Sequence; identical to SEQ ID NO: 1024
  Synthetic

SEQ ID NO: 1035 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1036 - protein, 230 aa, Artificial Sequence; identical to SEQ ID NO: 1024
  Synthetic

SEQ ID NO: 1037 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1038 - protein, 230 aa, Artificial Sequence; identical to SEQ ID NO: 1024
  Synthetic

SEQ ID NO: 1039 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1040 - protein, 236 aa, Artificial Sequence; identical to SEQ ID NO: 105
  Synthetic

SEQ ID NO: 1041 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1042 - protein, 236 aa, Artificial Sequence; identical to SEQ ID NO: 105
  Synthetic

SEQ ID NO: 1043 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1044 - protein, 236 aa, Artificial Sequence; identical to SEQ ID NO: 105
  Synthetic

SEQ ID NO: 1045 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1046 - protein, 236 aa, Artificial Sequence; identical to SEQ ID NO: 105
  Synthetic

SEQ ID NO: 1047 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1048 - protein, 236 aa, Artificial Sequence; identical to SEQ ID NO: 105
  Synthetic

SEQ ID NO: 1049 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1050 - protein, 236 aa, Artificial Sequence; identical to SEQ ID NO: 105
  Synthetic

SEQ ID NO: 1051 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1052 - protein, 236 aa, Artificial Sequence; identical to SEQ ID NO: 105
  Synthetic

SEQ ID NO: 1053 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1054 - protein, 236 aa, Artificial Sequence; identical to SEQ ID NO: 105
  Synthetic

SEQ ID NO: 1055 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1056 - protein, 236 aa, Artificial Sequence
  Synthetic
MDMRVPAQLLGLLLLWLRGARCDIQMTQSPSSLSASVGDRVTITCRASQSISSNLNWYQQKPGKAPKLLISAASNLQSGVPSRFSGSESGTDFTLTISSLQSEDFATYYCQQSDSLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1057 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1058 - protein, 236 aa, Artificial Sequence; identical to SEQ ID NO: 1056
  Synthetic

SEQ ID NO: 1059 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1060 - protein, 236 aa, Artificial Sequence; identical to SEQ ID NO: 1056
  Synthetic

SEQ ID NO: 1061 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1062 - protein, 236 aa, Artificial Sequence; identical to SEQ ID NO: 1056
  Synthetic

SEQ ID NO: 1063 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1064 - protein, 236 aa, Artificial Sequence; identical to SEQ ID NO: 1056
  Synthetic

SEQ ID NO: 1065 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1066 - protein, 236 aa, Artificial Sequence; identical to SEQ ID NO: 1056
  Synthetic

SEQ ID NO: 1067 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1068 - protein, 236 aa, Artificial Sequence; identical to SEQ ID NO: 1056
  Synthetic

SEQ ID NO: 1069 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1070 - protein, 236 aa, Artificial Sequence; identical to SEQ ID NO: 1056
  Synthetic

SEQ ID NO: 1071 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1072 - protein, 236 aa, Artificial Sequence
  Synthetic
MDMRVPAQLLGLLLLWLRGARCDIQMTQSPSSLSASVGDRVTITCQASQDIRKHLNWYQQKPGKAPNLLIYDAANLETGVPSRFSGSGSGTAFTFTISSLQPEDIATYYCQHYANLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1073 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1074 - protein, 236 aa, Artificial Sequence; identical to SEQ ID NO: 1072
  Synthetic

SEQ ID NO: 1075 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1076 - protein, 236 aa, Artificial Sequence; identical to SEQ ID NO: 1072
  Synthetic

SEQ ID NO: 1077 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1078 - protein, 236 aa, Artificial Sequence; identical to SEQ ID NO: 1072
  Synthetic

SEQ ID NO: 1079 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1080 - protein, 236 aa, Artificial Sequence; identical to SEQ ID NO: 1072
  Synthetic

SEQ ID NO: 1081 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1082 - protein, 236 aa, Artificial Sequence; identical to SEQ ID NO: 1072
  Synthetic

SEQ ID NO: 1083 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1084 - protein, 236 aa, Artificial Sequence; identical to SEQ ID NO: 1072
  Synthetic

SEQ ID NO: 1085 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1086 - protein, 236 aa, Artificial Sequence; identical to SEQ ID NO: 1072
  Synthetic

SEQ ID NO: 1087 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1088 - protein, 237 aa, Artificial Sequence; identical to SEQ ID NO: 864
  Synthetic

SEQ ID NO: 1089 - protein, 419 aa, Artificial Sequence
  Synthetic
MDMRVPAQLLGLLLLWLRGARCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1090 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1091 - protein, 237 aa, Artificial Sequence; identical to SEQ ID NO: 864
  Synthetic

SEQ ID NO: 1092 - protein, 419 aa, Artificial Sequence
  Synthetic
MDMRVPAQLLGLLLLWLRGARCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1093 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1094 - protein, 237 aa, Artificial Sequence; identical to SEQ ID NO: 864
  Synthetic

SEQ ID NO: 1095 - protein, 419 aa, Artificial Sequence
  Synthetic
MDMRVPAQLLGLLLLWLRGARCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1096 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1097 - protein, 237 aa, Artificial Sequence; identical to SEQ ID NO: 864
  Synthetic

SEQ ID NO: 1098 - protein, 419 aa, Artificial Sequence
  Synthetic
MDMRVPAQLLGLLLLWLRGARCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1099 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1100 - protein, 237 aa, Artificial Sequence; identical to SEQ ID NO: 864
  Synthetic

SEQ ID NO: 1101 - protein, 419 aa, Artificial Sequence
  Synthetic
MDMRVPAQLLGLLLLWLRGARCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1102 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1103 - protein, 237 aa, Artificial Sequence; identical to SEQ ID NO: 864
  Synthetic

SEQ ID NO: 1104 - protein, 419 aa, Artificial Sequence
  Synthetic
MDMRVPAQLLGLLLLWLRGARCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1105 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1106 - protein, 237 aa, Artificial Sequence; identical to SEQ ID NO: 864
  Synthetic

SEQ ID NO: 1107 - protein, 419 aa, Artificial Sequence
  Synthetic
MDMRVPAQLLGLLLLWLRGARCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1108 - protein, 641 aa, Artificial Sequence
  Synthetic
MDMRVPAQLLGLLLLWLRGARCEVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1109 - protein, 237 aa, Artificial Sequence; identical to SEQ ID NO: 864
  Synthetic

SEQ ID NO: 1110 - protein, 419 aa, Artificial Sequence
  Synthetic
MDMRVPAQLLGLLLLWLRGARCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1111 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1112 - protein, 237 aa, Artificial Sequence; identical to SEQ ID NO: 880
  Synthetic

SEQ ID NO: 1113 - protein, 419 aa, Artificial Sequence; identical to SEQ ID NO: 1089
  Synthetic

SEQ ID NO: 1114 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1115 - protein, 237 aa, Artificial Sequence; identical to SEQ ID NO: 880
  Synthetic

SEQ ID NO: 1116 - protein, 419 aa, Artificial Sequence; identical to SEQ ID NO: 1092
  Synthetic

SEQ ID NO: 1117 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1118 - protein, 237 aa, Artificial Sequence; identical to SEQ ID NO: 880
  Synthetic

SEQ ID NO: 1119 - protein, 419 aa, Artificial Sequence; identical to SEQ ID NO: 1095
  Synthetic

SEQ ID NO: 1120 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1121 - protein, 237 aa, Artificial Sequence; identical to SEQ ID NO: 880
  Synthetic

SEQ ID NO: 1122 - protein, 419 aa, Artificial Sequence; identical to SEQ ID NO: 1098
  Synthetic

SEQ ID NO: 1123 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1124 - protein, 237 aa, Artificial Sequence; identical to SEQ ID NO: 880
  Synthetic

SEQ ID NO: 1125 - protein, 419 aa, Artificial Sequence; identical to SEQ ID NO: 1101
  Synthetic

SEQ ID NO: 1126 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1127 - protein, 237 aa, Artificial Sequence; identical to SEQ ID NO: 880
  Synthetic

SEQ ID NO: 1128 - protein, 419 aa, Artificial Sequence; identical to SEQ ID NO: 1104
  Synthetic

SEQ ID NO: 1129 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1130 - protein, 237 aa, Artificial Sequence; identical to SEQ ID NO: 880
  Synthetic

SEQ ID NO: 1131 - protein, 419 aa, Artificial Sequence; identical to SEQ ID NO: 1107
  Synthetic

SEQ ID NO: 1132 - protein, 641 aa, Artificial Sequence
  Synthetic
MDMRVPAQLLGLLLLWLRGARCEVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1133 - protein, 237 aa, Artificial Sequence; identical to SEQ ID NO: 880
  Synthetic

SEQ ID NO: 1134 - protein, 419 aa, Artificial Sequence; identical to SEQ ID NO: 1110
  Synthetic

SEQ ID NO: 1135 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1136 - protein, 237 aa, Artificial Sequence; identical to SEQ ID NO: 205
  Synthetic

SEQ ID NO: 1137 - protein, 419 aa, Artificial Sequence; identical to SEQ ID NO: 1089
  Synthetic

SEQ ID NO: 1138 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1139 - protein, 237 aa, Artificial Sequence; identical to SEQ ID NO: 205
  Synthetic

SEQ ID NO: 1140 - protein, 419 aa, Artificial Sequence; identical to SEQ ID NO: 1092
  Synthetic

SEQ ID NO: 1141 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1142 - protein, 237 aa, Artificial Sequence; identical to SEQ ID NO: 205
  Synthetic

SEQ ID NO: 1143 - protein, 419 aa, Artificial Sequence; identical to SEQ ID NO: 1095
  Synthetic

SEQ ID NO: 1144 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1145 - protein, 237 aa, Artificial Sequence; identical to SEQ ID NO: 205
  Synthetic

SEQ ID NO: 1146 - protein, 419 aa, Artificial Sequence; identical to SEQ ID NO: 1098
  Synthetic

SEQ ID NO: 1147 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1148 - protein, 237 aa, Artificial Sequence; identical to SEQ ID NO: 205
  Synthetic

SEQ ID NO: 1149 - protein, 419 aa, Artificial Sequence; identical to SEQ ID NO: 1101
  Synthetic

SEQ ID NO: 1150 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1151 - protein, 237 aa, Artificial Sequence; identical to SEQ ID NO: 205
  Synthetic

SEQ ID NO: 1152 - protein, 419 aa, Artificial Sequence; identical to SEQ ID NO: 1104
  Synthetic

SEQ ID NO: 1153 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1154 - protein, 237 aa, Artificial Sequence; identical to SEQ ID NO: 205
  Synthetic

SEQ ID NO: 1155 - protein, 419 aa, Artificial Sequence; identical to SEQ ID NO: 1107
  Synthetic

SEQ ID NO: 1156 - protein, 641 aa, Artificial Sequence
  Synthetic
MDMRVPAQLLGLLLLWLRGARCEVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1157 - protein, 237 aa, Artificial Sequence; identical to SEQ ID NO: 205
  Synthetic

SEQ ID NO: 1158 - protein, 419 aa, Artificial Sequence; identical to SEQ ID NO: 1110
  Synthetic

SEQ ID NO: 1159 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1160 - protein, 236 aa, Artificial Sequence; identical to SEQ ID NO: 912
  Synthetic

SEQ ID NO: 1161 - protein, 419 aa, Artificial Sequence; identical to SEQ ID NO: 1089
  Synthetic

SEQ ID NO: 1162 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1163 - protein, 236 aa, Artificial Sequence; identical to SEQ ID NO: 912
  Synthetic

SEQ ID NO: 1164 - protein, 419 aa, Artificial Sequence; identical to SEQ ID NO: 1092
  Synthetic

SEQ ID NO: 1165 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1166 - protein, 236 aa, Artificial Sequence; identical to SEQ ID NO: 912
  Synthetic

SEQ ID NO: 1167 - protein, 419 aa, Artificial Sequence; identical to SEQ ID NO: 1095
  Synthetic

SEQ ID NO: 1168 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1169 - protein, 236 aa, Artificial Sequence; identical to SEQ ID NO: 912
  Synthetic

SEQ ID NO: 1170 - protein, 419 aa, Artificial Sequence; identical to SEQ ID NO: 1098
  Synthetic

SEQ ID NO: 1171 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1172 - protein, 236 aa, Artificial Sequence; identical to SEQ ID NO: 912
  Synthetic

SEQ ID NO: 1173 - protein, 419 aa, Artificial Sequence; identical to SEQ ID NO: 1101
  Synthetic

SEQ ID NO: 1174 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1175 - protein, 236 aa, Artificial Sequence; identical to SEQ ID NO: 912
  Synthetic

SEQ ID NO: 1176 - protein, 419 aa, Artificial Sequence; identical to SEQ ID NO: 1104
  Synthetic

SEQ ID NO: 1177 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1178 - protein, 236 aa, Artificial Sequence; identical to SEQ ID NO: 912
  Synthetic

SEQ ID NO: 1179 - protein, 419 aa, Artificial Sequence; identical to SEQ ID NO: 1107
  Synthetic

SEQ ID NO: 1180 - protein, 638 aa, Artificial Sequence
  Synthetic
MDMRVPAQLLGLLLLWLRGARCEVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1181 - protein, 236 aa, Artificial Sequence; identical to SEQ ID NO: 912
  Synthetic

SEQ ID NO: 1182 - protein, 419 aa, Artificial Sequence; identical to SEQ ID NO: 1110
  Synthetic

SEQ ID NO: 1183 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1184 - protein, 236 aa, Artificial Sequence; identical to SEQ ID NO: 165
  Synthetic

SEQ ID NO: 1185 - protein, 419 aa, Artificial Sequence; identical to SEQ ID NO: 1089
  Synthetic

SEQ ID NO: 1186 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1187 - protein, 236 aa, Artificial Sequence; identical to SEQ ID NO: 165
  Synthetic

SEQ ID NO: 1188 - protein, 419 aa, Artificial Sequence; identical to SEQ ID NO: 1092
  Synthetic

SEQ ID NO: 1189 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1190 - protein, 236 aa, Artificial Sequence; identical to SEQ ID NO: 165
  Synthetic

SEQ ID NO: 1191 - protein, 419 aa, Artificial Sequence; identical to SEQ ID NO: 1095
  Synthetic

SEQ ID NO: 1192 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1193 - protein, 236 aa, Artificial Sequence; identical to SEQ ID NO: 165
  Synthetic

SEQ ID NO: 1194 - protein, 419 aa, Artificial Sequence; identical to SEQ ID NO: 1098
  Synthetic

SEQ ID NO: 1195 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1196 - protein, 236 aa, Artificial Sequence; identical to SEQ ID NO: 165
  Synthetic

SEQ ID NO: 1197 - protein, 419 aa, Artificial Sequence; identical to SEQ ID NO: 1101
  Synthetic

SEQ ID NO: 1198 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1199 - protein, 236 aa, Artificial Sequence; identical to SEQ ID NO: 165
  Synthetic

SEQ ID NO: 1200 - protein, 419 aa, Artificial Sequence; identical to SEQ ID NO: 1104
  Synthetic

SEQ ID NO: 1201 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1202 - protein, 236 aa, Artificial Sequence; identical to SEQ ID NO: 165
  Synthetic

SEQ ID NO: 1203 - protein, 419 aa, Artificial Sequence; identical to SEQ ID NO: 1107
  Synthetic

SEQ ID NO: 1204 - protein, 639 aa, Artificial Sequence
  Synthetic
MDMRVPAQLLGLLLLWLRGARCEVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1205 - protein, 236 aa, Artificial Sequence; identical to SEQ ID NO: 165
  Synthetic

SEQ ID NO: 1206 - protein, 419 aa, Artificial Sequence; identical to SEQ ID NO: 1110
  Synthetic

SEQ ID NO: 1207 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1208 - protein, 236 aa, Artificial Sequence; identical to SEQ ID NO: 944
  Synthetic

SEQ ID NO: 1209 - protein, 419 aa, Artificial Sequence; identical to SEQ ID NO: 1089
  Synthetic

SEQ ID NO: 1210 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1211 - protein, 236 aa, Artificial Sequence; identical to SEQ ID NO: 944
  Synthetic

SEQ ID NO: 1212 - protein, 419 aa, Artificial Sequence; identical to SEQ ID NO: 1092
  Synthetic

SEQ ID NO: 1213 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1214 - protein, 236 aa, Artificial Sequence; identical to SEQ ID NO: 944
  Synthetic

SEQ ID NO: 1215 - protein, 419 aa, Artificial Sequence; identical to SEQ ID NO: 1095
  Synthetic

SEQ ID NO: 1216 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1217 - protein, 236 aa, Artificial Sequence; identical to SEQ ID NO: 944
  Synthetic

SEQ ID NO: 1218 - protein, 419 aa, Artificial Sequence; identical to SEQ ID NO: 1098
  Synthetic

SEQ ID NO: 1219 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1220 - protein, 236 aa, Artificial Sequence; identical to SEQ ID NO: 944
  Synthetic

SEQ ID NO: 1221 - protein, 419 aa, Artificial Sequence; identical to SEQ ID NO: 1101
  Synthetic

SEQ ID NO: 1222 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1223 - protein, 236 aa, Artificial Sequence; identical to SEQ ID NO: 944
  Synthetic

SEQ ID NO: 1224 - protein, 419 aa, Artificial Sequence; identical to SEQ ID NO: 1104
  Synthetic

SEQ ID NO: 1225 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1226 - protein, 236 aa, Artificial Sequence; identical to SEQ ID NO: 944
  Synthetic

SEQ ID NO: 1227 - protein, 419 aa, Artificial Sequence; identical to SEQ ID NO: 1107
  Synthetic

SEQ ID NO: 1228 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1229 - protein, 236 aa, Artificial Sequence; identical to SEQ ID NO: 944
  Synthetic

SEQ ID NO: 1230 - protein, 419 aa, Artificial Sequence; identical to SEQ ID NO: 1110
  Synthetic

SEQ ID NO: 1231 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1232 - protein, 236 aa, Artificial Sequence; identical to SEQ ID NO: 85
  Synthetic

SEQ ID NO: 1233 - protein, 419 aa, Artificial Sequence; identical to SEQ ID NO: 1104
  Synthetic

SEQ ID NO: 1234 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1235 - protein, 236 aa, Artificial Sequence; identical to SEQ ID NO: 85
  Synthetic

SEQ ID NO: 1236 - protein, 419 aa, Artificial Sequence; identical to SEQ ID NO: 1098
  Synthetic

SEQ ID NO: 1237 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1238 - protein, 236 aa, Artificial Sequence; identical to SEQ ID NO: 85
  Synthetic

SEQ ID NO: 1239 - protein, 419 aa, Artificial Sequence; identical to SEQ ID NO: 1089
  Synthetic

SEQ ID NO: 1240 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1241 - protein, 236 aa, Artificial Sequence; identical to SEQ ID NO: 85
  Synthetic

SEQ ID NO: 1242 - protein, 419 aa, Artificial Sequence; identical to SEQ ID NO: 1110
  Synthetic

SEQ ID NO: 1243 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1244 - protein, 236 aa, Artificial Sequence; identical to SEQ ID NO: 85
  Synthetic

SEQ ID NO: 1245 - protein, 419 aa, Artificial Sequence; identical to SEQ ID NO: 1092
  Synthetic

SEQ ID NO: 1246 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1247 - protein, 236 aa, Artificial Sequence; identical to SEQ ID NO: 85
  Synthetic

SEQ ID NO: 1248 - protein, 419 aa, Artificial Sequence; identical to SEQ ID NO: 1107
  Synthetic

SEQ ID NO: 1249 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1250 - protein, 236 aa, Artificial Sequence; identical to SEQ ID NO: 85
  Synthetic

SEQ ID NO: 1251 - protein, 419 aa, Artificial Sequence; identical to SEQ ID NO: 1101
  Synthetic

SEQ ID NO: 1252 - protein, 645 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1253 - protein, 236 aa, Artificial Sequence; identical to SEQ ID NO: 85
  Synthetic

SEQ ID NO: 1254 - protein, 419 aa, Artificial Sequence; identical to SEQ ID NO: 1095
  Synthetic

SEQ ID NO: 1255 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1256 - protein, 236 aa, Artificial Sequence; identical to SEQ ID NO: 65
  Synthetic

SEQ ID NO: 1257 - protein, 419 aa, Artificial Sequence; identical to SEQ ID NO: 1089
  Synthetic

SEQ ID NO: 1258 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1259 - protein, 236 aa, Artificial Sequence; identical to SEQ ID NO: 65
  Synthetic

SEQ ID NO: 1260 - protein, 419 aa, Artificial Sequence; identical to SEQ ID NO: 1092
  Synthetic

SEQ ID NO: 1261 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1262 - protein, 236 aa, Artificial Sequence; identical to SEQ ID NO: 65
  Synthetic

SEQ ID NO: 1263 - protein, 419 aa, Artificial Sequence; identical to SEQ ID NO: 1095
  Synthetic

SEQ ID NO: 1264 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1265 - protein, 236 aa, Artificial Sequence; identical to SEQ ID NO: 65
  Synthetic

SEQ ID NO: 1266 - protein, 419 aa, Artificial Sequence; identical to SEQ ID NO: 1098
  Synthetic

SEQ ID NO: 1267 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1268 - protein, 236 aa, Artificial Sequence; identical to SEQ ID NO: 65
  Synthetic

SEQ ID NO: 1269 - protein, 419 aa, Artificial Sequence; identical to SEQ ID NO: 1101
  Synthetic

SEQ ID NO: 1270 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1271 - protein, 236 aa, Artificial Sequence; identical to SEQ ID NO: 65
  Synthetic

SEQ ID NO: 1272 - protein, 419 aa, Artificial Sequence; identical to SEQ ID NO: 1104
  Synthetic

SEQ ID NO: 1273 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1274 - protein, 236 aa, Artificial Sequence; identical to SEQ ID NO: 65
  Synthetic

SEQ ID NO: 1275 - protein, 419 aa, Artificial Sequence; identical to SEQ ID NO: 1107
  Synthetic

SEQ ID NO: 1276 - protein, 644 aa, Artificial Sequence
  Synthetic
MDMRVPAQLLGLLLLWLRGARCQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1277 - protein, 236 aa, Artificial Sequence; identical to SEQ ID NO: 65
  Synthetic

SEQ ID NO: 1278 - protein, 419 aa, Artificial Sequence; identical to SEQ ID NO: 1110
  Synthetic

SEQ ID NO: 1279 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1280 - protein, 236 aa, Artificial Sequence; identical to SEQ ID NO: 45
  Synthetic

SEQ ID NO: 1281 - protein, 419 aa, Artificial Sequence; identical to SEQ ID NO: 1089
  Synthetic

SEQ ID NO: 1282 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1283 - protein, 236 aa, Artificial Sequence; identical to SEQ ID NO: 45
  Synthetic

SEQ ID NO: 1284 - protein, 419 aa, Artificial Sequence; identical to SEQ ID NO: 1092
  Synthetic

SEQ ID NO: 1285 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1286 - protein, 236 aa, Artificial Sequence; identical to SEQ ID NO: 45
  Synthetic

SEQ ID NO: 1287 - protein, 419 aa, Artificial Sequence; identical to SEQ ID NO: 1095
  Synthetic

SEQ ID NO: 1288 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1289 - protein, 236 aa, Artificial Sequence; identical to SEQ ID NO: 45
  Synthetic

SEQ ID NO: 1290 - protein, 419 aa, Artificial Sequence; identical to SEQ ID NO: 1098
  Synthetic

SEQ ID NO: 1291 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1292 - protein, 236 aa, Artificial Sequence; identical to SEQ ID NO: 45
  Synthetic

SEQ ID NO: 1293 - protein, 419 aa, Artificial Sequence; identical to SEQ ID NO: 1101
  Synthetic

SEQ ID NO: 1294 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1295 - protein, 236 aa, Artificial Sequence; identical to SEQ ID NO: 45
  Synthetic

SEQ ID NO: 1296 - protein, 419 aa, Artificial Sequence; identical to SEQ ID NO: 1104
  Synthetic

SEQ ID NO: 1297 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1298 - protein, 236 aa, Artificial Sequence; identical to SEQ ID NO: 45
  Synthetic

SEQ ID NO: 1299 - protein, 419 aa, Artificial Sequence; identical to SEQ ID NO: 1107
  Synthetic

SEQ ID NO: 1300 - protein, 646 aa, Artificial Sequence
  Synthetic
MDMRVPAQLLGLLLLWLRGARCQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1301 - protein, 236 aa, Artificial Sequence; identical to SEQ ID NO: 45
  Synthetic

SEQ ID NO: 1302 - protein, 419 aa, Artificial Sequence; identical to SEQ ID NO: 1110
  Synthetic

SEQ ID NO: 1303 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1304 - protein, 236 aa, Artificial Sequence; identical to SEQ ID NO: 25
  Synthetic

SEQ ID NO: 1305 - protein, 419 aa, Artificial Sequence; identical to SEQ ID NO: 1089
  Synthetic

SEQ ID NO: 1306 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1307 - protein, 236 aa, Artificial Sequence; identical to SEQ ID NO: 25
  Synthetic

SEQ ID NO: 1308 - protein, 419 aa, Artificial Sequence; identical to SEQ ID NO: 1092
  Synthetic

SEQ ID NO: 1309 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1310 - protein, 236 aa, Artificial Sequence; identical to SEQ ID NO: 25
  Synthetic

SEQ ID NO: 1311 - protein, 419 aa, Artificial Sequence; identical to SEQ ID NO: 1095
  Synthetic

SEQ ID NO: 1312 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1313 - protein, 236 aa, Artificial Sequence; identical to SEQ ID NO: 25
  Synthetic

SEQ ID NO: 1314 - protein, 419 aa, Artificial Sequence; identical to SEQ ID NO: 1098
  Synthetic

SEQ ID NO: 1315 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1316 - protein, 236 aa, Artificial Sequence; identical to SEQ ID NO: 25
  Synthetic

SEQ ID NO: 1317 - protein, 419 aa, Artificial Sequence; identical to SEQ ID NO: 1101
  Synthetic

SEQ ID NO: 1318 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1319 - protein, 236 aa, Artificial Sequence; identical to SEQ ID NO: 25
  Synthetic

SEQ ID NO: 1320 - protein, 419 aa, Artificial Sequence; identical to SEQ ID NO: 1104
  Synthetic

SEQ ID NO: 1321 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1322 - protein, 236 aa, Artificial Sequence; identical to SEQ ID NO: 25
  Synthetic

SEQ ID NO: 1323 - protein, 419 aa, Artificial Sequence; identical to SEQ ID NO: 1107
  Synthetic

SEQ ID NO: 1324 - protein, 644 aa, Artificial Sequence
  Synthetic
MDMRVPAQLLGLLLLWLRGARCQVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1325 - protein, 236 aa, Artificial Sequence; identical to SEQ ID NO: 25
  Synthetic

SEQ ID NO: 1326 - protein, 419 aa, Artificial Sequence; identical to SEQ ID NO: 1110
  Synthetic

SEQ ID NO: 1327 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1328 - protein, 230 aa, Artificial Sequence; identical to SEQ ID NO: 1024
  Synthetic

SEQ ID NO: 1329 - protein, 419 aa, Artificial Sequence; identical to SEQ ID NO: 1089
  Synthetic

SEQ ID NO: 1330 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1331 - protein, 230 aa, Artificial Sequence; identical to SEQ ID NO: 1024
  Synthetic

SEQ ID NO: 1332 - protein, 419 aa, Artificial Sequence; identical to SEQ ID NO: 1092
  Synthetic

SEQ ID NO: 1333 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1334 - protein, 230 aa, Artificial Sequence; identical to SEQ ID NO: 1024
  Synthetic

SEQ ID NO: 1335 - protein, 419 aa, Artificial Sequence; identical to SEQ ID NO: 1095
  Synthetic

SEQ ID NO: 1336 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1337 - protein, 230 aa, Artificial Sequence; identical to SEQ ID NO: 1024
  Synthetic

SEQ ID NO: 1338 - protein, 419 aa, Artificial Sequence; identical to SEQ ID NO: 1098
  Synthetic

SEQ ID NO: 1339 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1340 - protein, 230 aa, Artificial Sequence; identical to SEQ ID NO: 1024
  Synthetic

SEQ ID NO: 1341 - protein, 419 aa, Artificial Sequence; identical to SEQ ID NO: 1101
  Synthetic

SEQ ID NO: 1342 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1343 - protein, 230 aa, Artificial Sequence; identical to SEQ ID NO: 1024
  Synthetic

SEQ ID NO: 1344 - protein, 419 aa, Artificial Sequence; identical to SEQ ID NO: 1104
  Synthetic

SEQ ID NO: 1345 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1346 - protein, 230 aa, Artificial Sequence; identical to SEQ ID NO: 1024
  Synthetic

SEQ ID NO: 1347 - protein, 419 aa, Artificial Sequence; identical to SEQ ID NO: 1107
  Synthetic

SEQ ID NO: 1348 - protein, 643 aa, Artificial Sequence
  Synthetic
MDMRVPAQLLGLLLLWLRGARCQVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1349 - protein, 230 aa, Artificial Sequence; identical to SEQ ID NO: 1024
  Synthetic

SEQ ID NO: 1350 - protein, 419 aa, Artificial Sequence; identical to SEQ ID NO: 1110
  Synthetic

SEQ ID NO: 1351 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1352 - protein, 236 aa, Artificial Sequence; identical to SEQ ID NO: 105
  Synthetic

SEQ ID NO: 1353 - protein, 419 aa, Artificial Sequence; identical to SEQ ID NO: 1089
  Synthetic

SEQ ID NO: 1354 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1355 - protein, 236 aa, Artificial Sequence; identical to SEQ ID NO: 105
  Synthetic

SEQ ID NO: 1356 - protein, 419 aa, Artificial Sequence; identical to SEQ ID NO: 1092
  Synthetic

SEQ ID NO: 1357 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1358 - protein, 236 aa, Artificial Sequence; identical to SEQ ID NO: 105
  Synthetic

SEQ ID NO: 1359 - protein, 419 aa, Artificial Sequence; identical to SEQ ID NO: 1095
  Synthetic

SEQ ID NO: 1360 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1361 - protein, 236 aa, Artificial Sequence; identical to SEQ ID NO: 105
  Synthetic

SEQ ID NO: 1362 - protein, 419 aa, Artificial Sequence; identical to SEQ ID NO: 1098
  Synthetic

SEQ ID NO: 1363 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1364 - protein, 236 aa, Artificial Sequence; identical to SEQ ID NO: 105
  Synthetic

SEQ ID NO: 1365 - protein, 419 aa, Artificial Sequence; identical to SEQ ID NO: 1101
  Synthetic

SEQ ID NO: 1366 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1367 - protein, 236 aa, Artificial Sequence; identical to SEQ ID NO: 105
  Synthetic

SEQ ID NO: 1368 - protein, 419 aa, Artificial Sequence; identical to SEQ ID NO: 1104
  Synthetic

SEQ ID NO: 1369 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1370 - protein, 236 aa, Artificial Sequence; identical to SEQ ID NO: 105
  Synthetic

SEQ ID NO: 1371 - protein, 419 aa, Artificial Sequence; identical to SEQ ID NO: 1107
  Synthetic

SEQ ID NO: 1372 - protein, 644 aa, Artificial Sequence
  Synthetic
MDMRVPAQLLGLLLLWLRGARCQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1373 - protein, 236 aa, Artificial Sequence; identical to SEQ ID NO: 105
  Synthetic

SEQ ID NO: 1374 - protein, 419 aa, Artificial Sequence; identical to SEQ ID NO: 1110
  Synthetic

SEQ ID NO: 1375 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1376 - protein, 236 aa, Artificial Sequence; identical to SEQ ID NO: 1056
  Synthetic

SEQ ID NO: 1377 - protein, 419 aa, Artificial Sequence; identical to SEQ ID NO: 1089
  Synthetic

SEQ ID NO: 1378 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1379 - protein, 236 aa, Artificial Sequence; identical to SEQ ID NO: 1056
  Synthetic

SEQ ID NO: 1380 - protein, 419 aa, Artificial Sequence; identical to SEQ ID NO: 1092
  Synthetic

SEQ ID NO: 1381 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1382 - protein, 236 aa, Artificial Sequence; identical to SEQ ID NO: 1056
  Synthetic

SEQ ID NO: 1383 - protein, 419 aa, Artificial Sequence; identical to SEQ ID NO: 1095
  Synthetic

SEQ ID NO: 1384 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1385 - protein, 236 aa, Artificial Sequence; identical to SEQ ID NO: 1056
  Synthetic

SEQ ID NO: 1386 - protein, 419 aa, Artificial Sequence; identical to SEQ ID NO: 1098
  Synthetic

SEQ ID NO: 1387 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1388 - protein, 236 aa, Artificial Sequence; identical to SEQ ID NO: 1056
  Synthetic

SEQ ID NO: 1389 - protein, 419 aa, Artificial Sequence; identical to SEQ ID NO: 1101
  Synthetic

SEQ ID NO: 1390 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1391 - protein, 236 aa, Artificial Sequence; identical to SEQ ID NO: 1056
  Synthetic

SEQ ID NO: 1392 - protein, 419 aa, Artificial Sequence; identical to SEQ ID NO: 1104
  Synthetic

SEQ ID NO: 1393 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1394 - protein, 236 aa, Artificial Sequence; identical to SEQ ID NO: 1056
  Synthetic

SEQ ID NO: 1395 - protein, 419 aa, Artificial Sequence; identical to SEQ ID NO: 1107
  Synthetic

SEQ ID NO: 1396 - protein, 641 aa, Artificial Sequence
  Synthetic
MDMRVPAQLLGLLLLWLRGARCEVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1397 - protein, 236 aa, Artificial Sequence; identical to SEQ ID NO: 1056
  Synthetic

SEQ ID NO: 1398 - protein, 419 aa, Artificial Sequence; identical to SEQ ID NO: 1110
  Synthetic

SEQ ID NO: 1399 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1400 - protein, 236 aa, Artificial Sequence; identical to SEQ ID NO: 1072
  Synthetic

SEQ ID NO: 1401 - protein, 419 aa, Artificial Sequence; identical to SEQ ID NO: 1089
  Synthetic

SEQ ID NO: 1402 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYLAMSEFDIFINYIEAYMTMKIRN

SEQ ID NO: 1403 - protein, 236 aa, Artificial Sequence; identical to SEQ ID NO: 1072
  Synthetic

SEQ ID NO: 1404 - protein, 419 aa, Artificial Sequence; identical to SEQ ID NO: 1092
  Synthetic

SEQ ID NO: 1405 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 1406 - protein, 236 aa, Artificial Sequence; identical to SEQ ID NO: 1072
  Synthetic

SEQ ID NO: 1407 - protein, 419 aa, Artificial Sequence; identical to SEQ ID NO: 1095
  Synthetic

SEQ ID NO: 1408 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1409 - protein, 236 aa, Artificial Sequence; identical to SEQ ID NO: 1072
  Synthetic

SEQ ID NO: 1410 - protein, 419 aa, Artificial Sequence; identical to SEQ ID NO: 1098
  Synthetic

SEQ ID NO: 1411 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1412 - protein, 236 aa, Artificial Sequence; identical to SEQ ID NO: 1072
  Synthetic

SEQ ID NO: 1413 - protein, 419 aa, Artificial Sequence; identical to SEQ ID NO: 1101
  Synthetic

SEQ ID NO: 1414 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1415 - protein, 236 aa, Artificial Sequence; identical to SEQ ID NO: 1072
  Synthetic

SEQ ID NO: 1416 - protein, 419 aa, Artificial Sequence; identical to SEQ ID NO: 1104
  Synthetic

SEQ ID NO: 1417 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1418 - protein, 236 aa, Artificial Sequence; identical to SEQ ID NO: 1072
  Synthetic

SEQ ID NO: 1419 - protein, 419 aa, Artificial Sequence; identical to SEQ ID NO: 1107
  Synthetic

SEQ ID NO: 1420 - protein, 644 aa, Artificial Sequence
  Synthetic
MDMRVPAQLLGLLLLWLRGARCQVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 1421 - protein, 236 aa, Artificial Sequence; identical to SEQ ID NO: 1072
  Synthetic

SEQ ID NO: 1422 - protein, 419 aa, Artificial Sequence; identical to SEQ ID NO: 1110
  Synthetic

SEQ ID NO: 1423 - protein, 116 aa, Artificial Sequence
  Synthetic
SPGQGTQSENSCTHFPGNLPNMLRDLLDAFSRVKTFFQMKDQLDNLLLKESLLEDFKGYLGCQALSEMIQFYLEEVMPQAENQDPDIKAHVNSLGENLKTLRLRLRRCHRFLPCEN

SEQ ID NO: 1424 - protein, 44 aa, Artificial Sequence
  Synthetic
KSKAVEQVKNAFNKLQEKGIYKAMSEFDIFINYIEAYMTMKIRN

SEQ ID NO: 1425 - protein, 116 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCEN

SEQ ID NO: 1426 - protein, 44 aa, Artificial Sequence
  Synthetic
KSKAVEQVKNAFNKLQEKGIYLAMSEFDIFINYIEAYMTMKIRN

SEQ ID NO: 1427 - protein, 116 aa, Artificial Sequence; identical to SEQ ID NO: 1425
  Synthetic

SEQ ID NO: 1428 - protein, 44 aa, Artificial Sequence
  Synthetic
KSKAVEQVKNAFNKLQEKGIYDAMSEFDIFINYIEAYMTMKIRN

SEQ ID NO: 1429 - protein, 116 aa, Artificial Sequence
  Synthetic
SPGQGTQSENSCTHFPGNLPNMLRDLRDAFSRVKTFFQMKGQLDNLLLKESLLEDFKGYLGCQALSEMIQFYLEEVMPQAENQDPDIKAHVNSLGENLKTLRLRLRRCHRFLPCEN

SEQ ID NO: 1430 - protein, 44 aa, Artificial Sequence; identical to SEQ ID NO: 1424
  Synthetic

SEQ ID NO: 1431 - protein, 116 aa, Artificial Sequence
  Synthetic
SPGQGTQSENSCTHFPGNLPNMLRDLRDAFSRVKTFFRMKDQLDNLLLKESLLEDFKGYLGCQALSEMIQFYLEEVMPQAENQDPDIKAHVNSLGENLKTLRLRLRRCHRFLPCEN

SEQ ID NO: 1432 - protein, 44 aa, Artificial Sequence; identical to SEQ ID NO: 1424
  Synthetic

SEQ ID NO: 1433 - protein, 116 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCEN

SEQ ID NO: 1434 - protein, 44 aa, Artificial Sequence; identical to SEQ ID NO: 1424
  Synthetic

SEQ ID NO: 1435 - protein, 116 aa, Artificial Sequence
  Synthetic
SPGQGTQSENSCTHFPGNLPNMLRDLRDAFSRVDTFFQMKDQLDNLLLKESLLEDFKGYLGCQALSEMIQFYLEEVMPQAENQDPDIKAHVNSLGENLKTLRLRLRRCHRFLPCEN

SEQ ID NO: 1436 - protein, 44 aa, Artificial Sequence; identical to SEQ ID NO: 1424
  Synthetic

SEQ ID NO: 1437 - protein, 116 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCEN

SEQ ID NO: 1438 - protein, 44 aa, Artificial Sequence; identical to SEQ ID NO: 1424
  Synthetic

SEQ ID NO: 1439 - protein, 116 aa, Artificial Sequence; identical to SEQ ID NO: 1423
  Synthetic

SEQ ID NO: 1440 - protein, 44 aa, Artificial Sequence; identical to SEQ ID NO: 1424
  Synthetic

SEQ ID NO: 1441 - protein, 116 aa, Artificial Sequence; identical to SEQ ID NO: 1425
  Synthetic

SEQ ID NO: 1442 - protein, 44 aa, Artificial Sequence; identical to SEQ ID NO: 1426
  Synthetic

SEQ ID NO: 1443 - protein, 116 aa, Artificial Sequence; identical to SEQ ID NO: 1425
  Synthetic

SEQ ID NO: 1444 - protein, 44 aa, Artificial Sequence; identical to SEQ ID NO: 1428
  Synthetic

SEQ ID NO: 1445 - protein, 116 aa, Artificial Sequence; identical to SEQ ID NO: 1429
  Synthetic

SEQ ID NO: 1446 - protein, 44 aa, Artificial Sequence; identical to SEQ ID NO: 1424
  Synthetic

SEQ ID NO: 1447 - protein, 116 aa, Artificial Sequence; identical to SEQ ID NO: 1431
  Synthetic

SEQ ID NO: 1448 - protein, 44 aa, Artificial Sequence; identical to SEQ ID NO: 1424
  Synthetic

SEQ ID NO: 1449 - protein, 116 aa, Artificial Sequence; identical to SEQ ID NO: 1433
  Synthetic

SEQ ID NO: 1450 - protein, 44 aa, Artificial Sequence; identical to SEQ ID NO: 1424
  Synthetic

SEQ ID NO: 1451 - protein, 116 aa, Artificial Sequence; identical to SEQ ID NO: 1435
  Synthetic

SEQ ID NO: 1452 - protein, 44 aa, Artificial Sequence; identical to SEQ ID NO: 1424
  Synthetic

SEQ ID NO: 1453 - protein, 116 aa, Artificial Sequence; identical to SEQ ID NO: 1437
  Synthetic

SEQ ID NO: 1454 - protein, 44 aa, Artificial Sequence; identical to SEQ ID NO: 1424
  Synthetic

SEQ ID NO: 1455 - protein, 116 aa, Artificial Sequence; identical to SEQ ID NO: 1423
  Synthetic

SEQ ID NO: 1456 - protein, 44 aa, Artificial Sequence; identical to SEQ ID NO: 1424
  Synthetic

SEQ ID NO: 1457 - protein, 116 aa, Artificial Sequence; identical to SEQ ID NO: 1425
  Synthetic

SEQ ID NO: 1458 - protein, 44 aa, Artificial Sequence; identical to SEQ ID NO: 1426
  Synthetic

SEQ ID NO: 1459 - protein, 116 aa, Artificial Sequence; identical to SEQ ID NO: 1425
  Synthetic

SEQ ID NO: 1460 - protein, 44 aa, Artificial Sequence; identical to SEQ ID NO: 1428
  Synthetic

SEQ ID NO: 1461 - protein, 116 aa, Artificial Sequence; identical to SEQ ID NO: 1429
  Synthetic

SEQ ID NO: 1462 - protein, 44 aa, Artificial Sequence; identical to SEQ ID NO: 1424
  Synthetic

SEQ ID NO: 1463 - protein, 116 aa, Artificial Sequence; identical to SEQ ID NO: 1431
  Synthetic

SEQ ID NO: 1464 - protein, 44 aa, Artificial Sequence; identical to SEQ ID NO: 1424
  Synthetic

SEQ ID NO: 1465 - protein, 116 aa, Artificial Sequence; identical to SEQ ID NO: 1433
  Synthetic

SEQ ID NO: 1466 - protein, 44 aa, Artificial Sequence; identical to SEQ ID NO: 1424
  Synthetic

SEQ ID NO: 1467 - protein, 116 aa, Artificial Sequence; identical to SEQ ID NO: 1435
  Synthetic

SEQ ID NO: 1468 - protein, 44 aa, Artificial Sequence; identical to SEQ ID NO: 1424
  Synthetic

SEQ ID NO: 1469 - protein, 116 aa, Artificial Sequence; identical to SEQ ID NO: 1437
  Synthetic

SEQ ID NO: 1470 - protein, 44 aa, Artificial Sequence; identical to SEQ ID NO: 1424
  Synthetic

SEQ ID NO: 1471 - protein, 116 aa, Artificial Sequence; identical to SEQ ID NO: 1423
  Synthetic

SEQ ID NO: 1472 - protein, 44 aa, Artificial Sequence; identical to SEQ ID NO: 1424
  Synthetic

SEQ ID NO: 1473 - protein, 116 aa, Artificial Sequence; identical to SEQ ID NO: 1425
  Synthetic

SEQ ID NO: 1474 - protein, 44 aa, Artificial Sequence; identical to SEQ ID NO: 1426
  Synthetic

SEQ ID NO: 1475 - protein, 116 aa, Artificial Sequence; identical to SEQ ID NO: 1425
  Synthetic

SEQ ID NO: 1476 - protein, 44 aa, Artificial Sequence; identical to SEQ ID NO: 1428
  Synthetic

SEQ ID NO: 1477 - protein, 116 aa, Artificial Sequence; identical to SEQ ID NO: 1429
  Synthetic

SEQ ID NO: 1478 - protein, 44 aa, Artificial Sequence; identical to SEQ ID NO: 1424
  Synthetic

SEQ ID NO: 1479 - protein, 116 aa, Artificial Sequence; identical to SEQ ID NO: 1431
  Synthetic

SEQ ID NO: 1480 - protein, 44 aa, Artificial Sequence; identical to SEQ ID NO: 1424
  Synthetic

SEQ ID NO: 1481 - protein, 116 aa, Artificial Sequence; identical to SEQ ID NO: 1433
  Synthetic

SEQ ID NO: 1482 - protein, 44 aa, Artificial Sequence; identical to SEQ ID NO: 1424
  Synthetic

SEQ ID NO: 1483 - protein, 116 aa, Artificial Sequence; identical to SEQ ID NO: 1435
  Synthetic

SEQ ID NO: 1484 - protein, 44 aa, Artificial Sequence; identical to SEQ ID NO: 1424
  Synthetic

SEQ ID NO: 1485 - protein, 116 aa, Artificial Sequence; identical to SEQ ID NO: 1437
  Synthetic

SEQ ID NO: 1486 - protein, 44 aa, Artificial Sequence; identical to SEQ ID NO: 1424
  Synthetic

SEQ ID NO: 1487 - protein, 116 aa, Artificial Sequence; identical to SEQ ID NO: 1423
  Synthetic

SEQ ID NO: 1488 - protein, 44 aa, Artificial Sequence; identical to SEQ ID NO: 1424
  Synthetic

SEQ ID NO: 1489 - protein, 116 aa, Artificial Sequence; identical to SEQ ID NO: 1425
  Synthetic

SEQ ID NO: 1490 - protein, 44 aa, Artificial Sequence; identical to SEQ ID NO: 1426
  Synthetic

SEQ ID NO: 1491 - protein, 116 aa, Artificial Sequence; identical to SEQ ID NO: 1425
  Synthetic

SEQ ID NO: 1492 - protein, 44 aa, Artificial Sequence; identical to SEQ ID NO: 1428
  Synthetic

SEQ ID NO: 1493 - protein, 116 aa, Artificial Sequence; identical to SEQ ID NO: 1429
  Synthetic

SEQ ID NO: 1494 - protein, 44 aa, Artificial Sequence; identical to SEQ ID NO: 1424
  Synthetic

SEQ ID NO: 1495 - protein, 116 aa, Artificial Sequence; identical to SEQ ID NO: 1431
  Synthetic

SEQ ID NO: 1496 - protein, 44 aa, Artificial Sequence; identical to SEQ ID NO: 1424
  Synthetic

SEQ ID NO: 1497 - protein, 116 aa, Artificial Sequence; identical to SEQ ID NO: 1433
  Synthetic

SEQ ID NO: 1498 - protein, 44 aa, Artificial Sequence; identical to SEQ ID NO: 1424
  Synthetic

SEQ ID NO: 1499 - protein, 116 aa, Artificial Sequence; identical to SEQ ID NO: 1435
  Synthetic

SEQ ID NO: 1500 - protein, 44 aa, Artificial Sequence; identical to SEQ ID NO: 1424
  Synthetic

SEQ ID NO: 1501 - protein, 116 aa, Artificial Sequence; identical to SEQ ID NO: 1437
  Synthetic

SEQ ID NO: 1502 - protein, 44 aa, Artificial Sequence; identical to SEQ ID NO: 1424
  Synthetic

SEQ ID NO: 1503 - protein, 116 aa, Artificial Sequence; identical to SEQ ID NO: 1423
  Synthetic

SEQ ID NO: 1504 - protein, 44 aa, Artificial Sequence; identical to SEQ ID NO: 1424
  Synthetic

SEQ ID NO: 1505 - protein, 116 aa, Artificial Sequence; identical to SEQ ID NO: 1425
  Synthetic

SEQ ID NO: 1506 - protein, 44 aa, Artificial Sequence; identical to SEQ ID NO: 1426
  Synthetic

SEQ ID NO: 1507 - protein, 116 aa, Artificial Sequence; identical to SEQ ID NO: 1425
  Synthetic

SEQ ID NO: 1508 - protein, 44 aa, Artificial Sequence; identical to SEQ ID NO: 1428
  Synthetic

SEQ ID NO: 1509 - protein, 116 aa, Artificial Sequence; identical to SEQ ID NO: 1429
  Synthetic

SEQ ID NO: 1510 - protein, 44 aa, Artificial Sequence; identical to SEQ ID NO: 1424
  Synthetic

SEQ ID NO: 1511 - protein, 116 aa, Artificial Sequence; identical to SEQ ID NO: 1431
  Synthetic

SEQ ID NO: 1512 - protein, 44 aa, Artificial Sequence; identical to SEQ ID NO: 1424
  Synthetic

SEQ ID NO: 1513 - protein, 116 aa, Artificial Sequence; identical to SEQ ID NO: 1433
  Synthetic

SEQ ID NO: 1514 - protein, 44 aa, Artificial Sequence; identical to SEQ ID NO: 1424
  Synthetic

SEQ ID NO: 1515 - protein, 116 aa, Artificial Sequence; identical to SEQ ID NO: 1435
  Synthetic

SEQ ID NO: 1516 - protein, 44 aa, Artificial Sequence; identical to SEQ ID NO: 1424
  Synthetic

SEQ ID NO: 1517 - protein, 116 aa, Artificial Sequence; identical to SEQ ID NO: 1437
  Synthetic

SEQ ID NO: 1518 - protein, 44 aa, Artificial Sequence; identical to SEQ ID NO: 1424
  Synthetic

SEQ ID NO: 1519 - protein, 116 aa, Artificial Sequence; identical to SEQ ID NO: 1423
  Synthetic

SEQ ID NO: 1520 - protein, 44 aa, Artificial Sequence; identical to SEQ ID NO: 1424
  Synthetic

SEQ ID NO: 1521 - protein, 116 aa, Artificial Sequence; identical to SEQ ID NO: 1425
  Synthetic

SEQ ID NO: 1522 - protein, 44 aa, Artificial Sequence; identical to SEQ ID NO: 1426
  Synthetic

SEQ ID NO: 1523 - protein, 116 aa, Artificial Sequence; identical to SEQ ID NO: 1425
  Synthetic

SEQ ID NO: 1524 - protein, 44 aa, Artificial Sequence; identical to SEQ ID NO: 1428
  Synthetic

SEQ ID NO: 1525 - protein, 116 aa, Artificial Sequence; identical to SEQ ID NO: 1429
  Synthetic

SEQ ID NO: 1526 - protein, 44 aa, Artificial Sequence; identical to SEQ ID NO: 1424
  Synthetic

SEQ ID NO: 1527 - protein, 116 aa, Artificial Sequence; identical to SEQ ID NO: 1431
  Synthetic

SEQ ID NO: 1528 - protein, 44 aa, Artificial Sequence; identical to SEQ ID NO: 1424
  Synthetic

SEQ ID NO: 1529 - protein, 116 aa, Artificial Sequence; identical to SEQ ID NO: 1433
  Synthetic

SEQ ID NO: 1530 - protein, 44 aa, Artificial Sequence; identical to SEQ ID NO: 1424
  Synthetic

SEQ ID NO: 1531 - protein, 116 aa, Artificial Sequence; identical to SEQ ID NO: 1435
  Synthetic

SEQ ID NO: 1532 - protein, 44 aa, Artificial Sequence; identical to SEQ ID NO: 1424
  Synthetic

SEQ ID NO: 1533 - protein, 116 aa, Artificial Sequence; identical to SEQ ID NO: 1437
  Synthetic

SEQ ID NO: 1534 - protein, 44 aa, Artificial Sequence; identical to SEQ ID NO: 1424
  Synthetic

SEQ ID NO: 1535 - protein, 116 aa, Artificial Sequence; identical to SEQ ID NO: 1423
  Synthetic

SEQ ID NO: 1536 - protein, 44 aa, Artificial Sequence; identical to SEQ ID NO: 1424
  Synthetic

SEQ ID NO: 1537 - protein, 116 aa, Artificial Sequence; identical to SEQ ID NO: 1425
  Synthetic

SEQ ID NO: 1538 - protein, 44 aa, Artificial Sequence; identical to SEQ ID NO: 1426
  Synthetic

SEQ ID NO: 1539 - protein, 116 aa, Artificial Sequence; identical to SEQ ID NO: 1425
  Synthetic

SEQ ID NO: 1540 - protein, 44 aa, Artificial Sequence; identical to SEQ ID NO: 1428
  Synthetic

SEQ ID NO: 1541 - protein, 116 aa, Artificial Sequence; identical to SEQ ID NO: 1429
  Synthetic

SEQ ID NO: 1542 - protein, 44 aa, Artificial Sequence; identical to SEQ ID NO: 1424
  Synthetic

SEQ ID NO: 1543 - protein, 116 aa, Artificial Sequence; identical to SEQ ID NO: 1431
  Synthetic

SEQ ID NO: 1544 - protein, 44 aa, Artificial Sequence; identical to SEQ ID NO: 1424
  Synthetic

SEQ ID NO: 1545 - protein, 116 aa, Artificial Sequence; identical to SEQ ID NO: 1433
  Synthetic

SEQ ID NO: 1546 - protein, 44 aa, Artificial Sequence; identical to SEQ ID NO: 1424
  Synthetic

SEQ ID NO: 1547 - protein, 116 aa, Artificial Sequence; identical to SEQ ID NO: 1435
  Synthetic

SEQ ID NO: 1548 - protein, 44 aa, Artificial Sequence; identical to SEQ ID NO: 1424
  Synthetic

SEQ ID NO: 1549 - protein, 116 aa, Artificial Sequence; identical to SEQ ID NO: 1437
  Synthetic

SEQ ID NO: 1550 - protein, 44 aa, Artificial Sequence; identical to SEQ ID NO: 1424
  Synthetic

SEQ ID NO: 1551 - protein, 116 aa, Artificial Sequence; identical to SEQ ID NO: 1423
  Synthetic

SEQ ID NO: 1552 - protein, 44 aa, Artificial Sequence; identical to SEQ ID NO: 1424
  Synthetic

SEQ ID NO: 1553 - protein, 116 aa, Artificial Sequence; identical to SEQ ID NO: 1425
  Synthetic

SEQ ID NO: 1554 - protein, 44 aa, Artificial Sequence; identical to SEQ ID NO: 1426
  Synthetic

SEQ ID NO: 1555 - protein, 116 aa, Artificial Sequence; identical to SEQ ID NO: 1425
  Synthetic

SEQ ID NO: 1556 - protein, 44 aa, Artificial Sequence; identical to SEQ ID NO: 1428
  Synthetic

SEQ ID NO: 1557 - protein, 116 aa, Artificial Sequence; identical to SEQ ID NO: 1429
  Synthetic

SEQ ID NO: 1558 - protein, 44 aa, Artificial Sequence; identical to SEQ ID NO: 1424
  Synthetic

SEQ ID NO: 1559 - protein, 116 aa, Artificial Sequence; identical to SEQ ID NO: 1431
  Synthetic

SEQ ID NO: 1560 - protein, 44 aa, Artificial Sequence; identical to SEQ ID NO: 1424
  Synthetic

SEQ ID NO: 1561 - protein, 116 aa, Artificial Sequence; identical to SEQ ID NO: 1433
  Synthetic

SEQ ID NO: 1562 - protein, 44 aa, Artificial Sequence; identical to SEQ ID NO: 1424
  Synthetic

SEQ ID NO: 1563 - protein, 116 aa, Artificial Sequence; identical to SEQ ID NO: 1435
  Synthetic

SEQ ID NO: 1564 - protein, 44 aa, Artificial Sequence; identical to SEQ ID NO: 1424
  Synthetic

SEQ ID NO: 1565 - protein, 116 aa, Artificial Sequence; identical to SEQ ID NO: 1437
  Synthetic

SEQ ID NO: 1566 - protein, 44 aa, Artificial Sequence; identical to SEQ ID NO: 1424
  Synthetic

SEQ ID NO: 1567 - protein, 116 aa, Artificial Sequence; identical to SEQ ID NO: 1423
  Synthetic

SEQ ID NO: 1568 - protein, 44 aa, Artificial Sequence; identical to SEQ ID NO: 1424
  Synthetic

SEQ ID NO: 1569 - protein, 116 aa, Artificial Sequence; identical to SEQ ID NO: 1425
  Synthetic

SEQ ID NO: 1570 - protein, 44 aa, Artificial Sequence; identical to SEQ ID NO: 1426
  Synthetic

SEQ ID NO: 1571 - protein, 116 aa, Artificial Sequence; identical to SEQ ID NO: 1425
  Synthetic

SEQ ID NO: 1572 - protein, 44 aa, Artificial Sequence; identical to SEQ ID NO: 1428
  Synthetic

SEQ ID NO: 1573 - protein, 116 aa, Artificial Sequence; identical to SEQ ID NO: 1429
  Synthetic

SEQ ID NO: 1574 - protein, 44 aa, Artificial Sequence; identical to SEQ ID NO: 1424
  Synthetic

SEQ ID NO: 1575 - protein, 116 aa, Artificial Sequence; identical to SEQ ID NO: 1431
  Synthetic

SEQ ID NO: 1576 - protein, 44 aa, Artificial Sequence; identical to SEQ ID NO: 1424
  Synthetic

SEQ ID NO: 1577 - protein, 116 aa, Artificial Sequence; identical to SEQ ID NO: 1433
  Synthetic

SEQ ID NO: 1578 - protein, 44 aa, Artificial Sequence; identical to SEQ ID NO: 1424
  Synthetic

SEQ ID NO: 1579 - protein, 116 aa, Artificial Sequence; identical to SEQ ID NO: 1435
  Synthetic

SEQ ID NO: 1580 - protein, 44 aa, Artificial Sequence; identical to SEQ ID NO: 1424
  Synthetic

SEQ ID NO: 1581 - protein, 116 aa, Artificial Sequence; identical to SEQ ID NO: 1437
  Synthetic

SEQ ID NO: 1582 - protein, 44 aa, Artificial Sequence; identical to SEQ ID NO: 1424
  Synthetic

SEQ ID NO: 1583 - protein, 116 aa, Artificial Sequence; identical to SEQ ID NO: 1423
  Synthetic

SEQ ID NO: 1584 - protein, 44 aa, Artificial Sequence; identical to SEQ ID NO: 1424
  Synthetic

SEQ ID NO: 1585 - protein, 116 aa, Artificial Sequence; identical to SEQ ID NO: 1425
  Synthetic

SEQ ID NO: 1586 - protein, 44 aa, Artificial Sequence; identical to SEQ ID NO: 1426
  Synthetic

SEQ ID NO: 1587 - protein, 116 aa, Artificial Sequence; identical to SEQ ID NO: 1425
  Synthetic

SEQ ID NO: 1588 - protein, 44 aa, Artificial Sequence; identical to SEQ ID NO: 1428
  Synthetic

SEQ ID NO: 1589 - protein, 116 aa, Artificial Sequence; identical to SEQ ID NO: 1429
  Synthetic

SEQ ID NO: 1590 - protein, 44 aa, Artificial Sequence; identical to SEQ ID NO: 1424
  Synthetic

SEQ ID NO: 1591 - protein, 116 aa, Artificial Sequence; identical to SEQ ID NO: 1431
  Synthetic

SEQ ID NO: 1592 - protein, 44 aa, Artificial Sequence; identical to SEQ ID NO: 1424
  Synthetic

SEQ ID NO: 1593 - protein, 116 aa, Artificial Sequence; identical to SEQ ID NO: 1433
  Synthetic

SEQ ID NO: 1594 - protein, 44 aa, Artificial Sequence; identical to SEQ ID NO: 1424
  Synthetic

SEQ ID NO: 1595 - protein, 116 aa, Artificial Sequence; identical to SEQ ID NO: 1435
  Synthetic

SEQ ID NO: 1596 - protein, 44 aa, Artificial Sequence; identical to SEQ ID NO: 1424
  Synthetic

SEQ ID NO: 1597 - protein, 116 aa, Artificial Sequence; identical to SEQ ID NO: 1437
  Synthetic

SEQ ID NO: 1598 - protein, 44 aa, Artificial Sequence; identical to SEQ ID NO: 1424
  Synthetic

SEQ ID NO: 1599 - protein, 116 aa, Artificial Sequence; identical to SEQ ID NO: 1423
  Synthetic

SEQ ID NO: 1600 - protein, 44 aa, Artificial Sequence; identical to SEQ ID NO: 1424
  Synthetic

SEQ ID NO: 1601 - protein, 116 aa, Artificial Sequence; identical to SEQ ID NO: 1425
  Synthetic

SEQ ID NO: 1602 - protein, 44 aa, Artificial Sequence; identical to SEQ ID NO: 1426
  Synthetic

SEQ ID NO: 1603 - protein, 116 aa, Artificial Sequence; identical to SEQ ID NO: 1425
  Synthetic

SEQ ID NO: 1604 - protein, 44 aa, Artificial Sequence; identical to SEQ ID NO: 1428
  Synthetic

SEQ ID NO: 1605 - protein, 116 aa, Artificial Sequence; identical to SEQ ID NO: 1429
  Synthetic

SEQ ID NO: 1606 - protein, 44 aa, Artificial Sequence; identical to SEQ ID NO: 1424
  Synthetic

SEQ ID NO: 1607 - protein, 116 aa, Artificial Sequence; identical to SEQ ID NO: 1431
  Synthetic

SEQ ID NO: 1608 - protein, 44 aa, Artificial Sequence; identical to SEQ ID NO: 1424
  Synthetic

SEQ ID NO: 1609 - protein, 116 aa, Artificial Sequence; identical to SEQ ID NO: 1433
  Synthetic

SEQ ID NO: 1610 - protein, 44 aa, Artificial Sequence; identical to SEQ ID NO: 1424
  Synthetic

SEQ ID NO: 1611 - protein, 116 aa, Artificial Sequence; identical to SEQ ID NO: 1435
  Synthetic

SEQ ID NO: 1612 - protein, 44 aa, Artificial Sequence; identical to SEQ ID NO: 1424
  Synthetic

SEQ ID NO: 1613 - protein, 116 aa, Artificial Sequence; identical to SEQ ID NO: 1437
  Synthetic

SEQ ID NO: 1614 - protein, 44 aa, Artificial Sequence; identical to SEQ ID NO: 1424
  Synthetic

SEQ ID NO: 1615 - protein, 116 aa, Artificial Sequence; identical to SEQ ID NO: 1423
  Synthetic

SEQ ID NO: 1616 - protein, 44 aa, Artificial Sequence; identical to SEQ ID NO: 1424
  Synthetic

SEQ ID NO: 1617 - protein, 116 aa, Artificial Sequence; identical to SEQ ID NO: 1425
  Synthetic

SEQ ID NO: 1618 - protein, 44 aa, Artificial Sequence; identical to SEQ ID NO: 1426
  Synthetic

SEQ ID NO: 1619 - protein, 116 aa, Artificial Sequence; identical to SEQ ID NO: 1425
  Synthetic

SEQ ID NO: 1620 - protein, 44 aa, Artificial Sequence; identical to SEQ ID NO: 1428
  Synthetic

SEQ ID NO: 1621 - protein, 116 aa, Artificial Sequence; identical to SEQ ID NO: 1429
  Synthetic

SEQ ID NO: 1622 - protein, 44 aa, Artificial Sequence; identical to SEQ ID NO: 1424
  Synthetic

SEQ ID NO: 1623 - protein, 116 aa, Artificial Sequence; identical to SEQ ID NO: 1431
  Synthetic

SEQ ID NO: 1624 - protein, 44 aa, Artificial Sequence; identical to SEQ ID NO: 1424
  Synthetic

SEQ ID NO: 1625 - protein, 116 aa, Artificial Sequence; identical to SEQ ID NO: 1433
  Synthetic

SEQ ID NO: 1626 - protein, 44 aa, Artificial Sequence; identical to SEQ ID NO: 1424
  Synthetic

SEQ ID NO: 1627 - protein, 116 aa, Artificial Sequence; identical to SEQ ID NO: 1435
  Synthetic

SEQ ID NO: 1628 - protein, 44 aa, Artificial Sequence; identical to SEQ ID NO: 1424
  Synthetic

SEQ ID NO: 1629 - protein, 116 aa, Artificial Sequence; identical to SEQ ID NO: 1437
  Synthetic

SEQ ID NO: 1630 - protein, 44 aa, Artificial Sequence; identical to SEQ ID NO: 1424
  Synthetic

SEQ ID NO: 1631 - protein, 116 aa, Artificial Sequence; identical to SEQ ID NO: 1423
  Synthetic

SEQ ID NO: 1632 - protein, 44 aa, Artificial Sequence; identical to SEQ ID NO: 1424
  Synthetic

SEQ ID NO: 1633 - protein, 116 aa, Artificial Sequence; identical to SEQ ID NO: 1425
  Synthetic

SEQ ID NO: 1634 - protein, 44 aa, Artificial Sequence; identical to SEQ ID NO: 1426
  Synthetic

SEQ ID NO: 1635 - protein, 116 aa, Artificial Sequence; identical to SEQ ID NO: 1425
  Synthetic

SEQ ID NO: 1636 - protein, 44 aa, Artificial Sequence; identical to SEQ ID NO: 1428
  Synthetic

SEQ ID NO: 1637 - protein, 116 aa, Artificial Sequence; identical to SEQ ID NO: 1429
  Synthetic

SEQ ID NO: 1638 - protein, 44 aa, Artificial Sequence; identical to SEQ ID NO: 1424
  Synthetic

SEQ ID NO: 1639 - protein, 116 aa, Artificial Sequence; identical to SEQ ID NO: 1431
  Synthetic

SEQ ID NO: 1640 - protein, 44 aa, Artificial Sequence; identical to SEQ ID NO: 1424
  Synthetic

SEQ ID NO: 1641 - protein, 116 aa, Artificial Sequence; identical to SEQ ID NO: 1433
  Synthetic

SEQ ID NO: 1642 - protein, 44 aa, Artificial Sequence; identical to SEQ ID NO: 1424
  Synthetic

SEQ ID NO: 1643 - protein, 116 aa, Artificial Sequence; identical to SEQ ID NO: 1435
  Synthetic

SEQ ID NO: 1644 - protein, 44 aa, Artificial Sequence; identical to SEQ ID NO: 1424
  Synthetic

SEQ ID NO: 1645 - protein, 116 aa, Artificial Sequence; identical to SEQ ID NO: 1437
  Synthetic

SEQ ID NO: 1646 - protein, 44 aa, Artificial Sequence; identical to SEQ ID NO: 1424
  Synthetic

SEQ ID NO: 1647 - protein, 116 aa, Artificial Sequence; identical to SEQ ID NO: 1423
  Synthetic

SEQ ID NO: 1648 - protein, 44 aa, Artificial Sequence; identical to SEQ ID NO: 1424
  Synthetic

SEQ ID NO: 1649 - protein, 116 aa, Artificial Sequence; identical to SEQ ID NO: 1425
  Synthetic

SEQ ID NO: 1650 - protein, 44 aa, Artificial Sequence; identical to SEQ ID NO: 1426
  Synthetic

SEQ ID NO: 1651 - protein, 116 aa, Artificial Sequence; identical to SEQ ID NO: 1425
  Synthetic

SEQ ID NO: 1652 - protein, 44 aa, Artificial Sequence; identical to SEQ ID NO: 1428
  Synthetic

SEQ ID NO: 1653 - protein, 116 aa, Artificial Sequence; identical to SEQ ID NO: 1429
  Synthetic

SEQ ID NO: 1654 - protein, 44 aa, Artificial Sequence; identical to SEQ ID NO: 1424
  Synthetic

SEQ ID NO: 1655 - protein, 116 aa, Artificial Sequence; identical to SEQ ID NO: 1431
  Synthetic

SEQ ID NO: 1656 - protein, 44 aa, Artificial Sequence; identical to SEQ ID NO: 1424
  Synthetic

SEQ ID NO: 1657 - protein, 116 aa, Artificial Sequence; identical to SEQ ID NO: 1433
  Synthetic

SEQ ID NO: 1658 - protein, 44 aa, Artificial Sequence; identical to SEQ ID NO: 1424
  Synthetic

SEQ ID NO: 1659 - protein, 116 aa, Artificial Sequence; identical to SEQ ID NO: 1435
  Synthetic

SEQ ID NO: 1660 - protein, 44 aa, Artificial Sequence; identical to SEQ ID NO: 1424
  Synthetic

SEQ ID NO: 1661 - protein, 116 aa, Artificial Sequence; identical to SEQ ID NO: 1437
  Synthetic

SEQ ID NO: 1662 - protein, 44 aa, Artificial Sequence; identical to SEQ ID NO: 1424
  Synthetic

SEQ ID NO: 1663 - protein, 116 aa, Artificial Sequence; identical to SEQ ID NO: 1423
  Synthetic

SEQ ID NO: 1664 - protein, 44 aa, Artificial Sequence; identical to SEQ ID NO: 1424
  Synthetic

SEQ ID NO: 1665 - protein, 116 aa, Artificial Sequence; identical to SEQ ID NO: 1425
  Synthetic

SEQ ID NO: 1666 - protein, 44 aa, Artificial Sequence; identical to SEQ ID NO: 1426
  Synthetic

SEQ ID NO: 1667 - protein, 116 aa, Artificial Sequence; identical to SEQ ID NO: 1425
  Synthetic

SEQ ID NO: 1668 - protein, 44 aa, Artificial Sequence; identical to SEQ ID NO: 1428
  Synthetic

SEQ ID NO: 1669 - protein, 116 aa, Artificial Sequence; identical to SEQ ID NO: 1429
  Synthetic

SEQ ID NO: 1670 - protein, 44 aa, Artificial Sequence; identical to SEQ ID NO: 1424
  Synthetic

SEQ ID NO: 1671 - protein, 116 aa, Artificial Sequence; identical to SEQ ID NO: 1431
  Synthetic

SEQ ID NO: 1672 - protein, 44 aa, Artificial Sequence; identical to SEQ ID NO: 1424
  Synthetic

SEQ ID NO: 1673 - protein, 116 aa, Artificial Sequence; identical to SEQ ID NO: 1433
  Synthetic

SEQ ID NO: 1674 - protein, 44 aa, Artificial Sequence; identical to SEQ ID NO: 1424
  Synthetic

SEQ ID NO: 1675 - protein, 116 aa, Artificial Sequence; identical to SEQ ID NO: 1435
  Synthetic

SEQ ID NO: 1676 - protein, 44 aa, Artificial Sequence; identical to SEQ ID NO: 1424
  Synthetic

SEQ ID NO: 1677 - protein, 116 aa, Artificial Sequence; identical to SEQ ID NO: 1437
  Synthetic

SEQ ID NO: 1678 - protein, 44 aa, Artificial Sequence; identical to SEQ ID NO: 1424
  Synthetic

SEQ ID NO: 1679 - protein, 116 aa, Artificial Sequence; identical to SEQ ID NO: 1423
  Synthetic

SEQ ID NO: 1680 - protein, 44 aa, Artificial Sequence; identical to SEQ ID NO: 1424
  Synthetic

SEQ ID NO: 1681 - protein, 116 aa, Artificial Sequence; identical to SEQ ID NO: 1425
  Synthetic

SEQ ID NO: 1682 - protein, 44 aa, Artificial Sequence; identical to SEQ ID NO: 1426
  Synthetic

SEQ ID NO: 1683 - protein, 116 aa, Artificial Sequence; identical to SEQ ID NO: 1425
  Synthetic

SEQ ID NO: 1684 - protein, 44 aa, Artificial Sequence; identical to SEQ ID NO: 1428
  Synthetic

SEQ ID NO: 1685 - protein, 116 aa, Artificial Sequence; identical to SEQ ID NO: 1429
  Synthetic

SEQ ID NO: 1686 - protein, 44 aa, Artificial Sequence; identical to SEQ ID NO: 1424
  Synthetic

SEQ ID NO: 1687 - protein, 116 aa, Artificial Sequence; identical to SEQ ID NO: 1431
  Synthetic

SEQ ID NO: 1688 - protein, 44 aa, Artificial Sequence; identical to SEQ ID NO: 1424
  Synthetic

SEQ ID NO: 1689 - protein, 116 aa, Artificial Sequence; identical to SEQ ID NO: 1433
  Synthetic

SEQ ID NO: 1690 - protein, 44 aa, Artificial Sequence; identical to SEQ ID NO: 1424
  Synthetic

SEQ ID NO: 1691 - protein, 116 aa, Artificial Sequence; identical to SEQ ID NO: 1435
  Synthetic

SEQ ID NO: 1692 - protein, 44 aa, Artificial Sequence; identical to SEQ ID NO: 1424
  Synthetic

SEQ ID NO: 1693 - protein, 116 aa, Artificial Sequence; identical to SEQ ID NO: 1437
  Synthetic

SEQ ID NO: 1694 - protein, 44 aa, Artificial Sequence; identical to SEQ ID NO: 1424
  Synthetic

SEQ ID NO: 1695 - protein, 116 aa, Artificial Sequence; identical to SEQ ID NO: 1423
  Synthetic

SEQ ID NO: 1696 - protein, 44 aa, Artificial Sequence; identical to SEQ ID NO: 1424
  Synthetic

SEQ ID NO: 1697 - protein, 116 aa, Artificial Sequence; identical to SEQ ID NO: 1425
  Synthetic

SEQ ID NO: 1698 - protein, 44 aa, Artificial Sequence; identical to SEQ ID NO: 1426
  Synthetic

SEQ ID NO: 1699 - protein, 116 aa, Artificial Sequence; identical to SEQ ID NO: 1425
  Synthetic

SEQ ID NO: 1700 - protein, 44 aa, Artificial Sequence; identical to SEQ ID NO: 1428
  Synthetic

SEQ ID NO: 1701 - protein, 116 aa, Artificial Sequence; identical to SEQ ID NO: 1429
  Synthetic

SEQ ID NO: 1702 - protein, 44 aa, Artificial Sequence; identical to SEQ ID NO: 1424
  Synthetic

SEQ ID NO: 1703 - protein, 116 aa, Artificial Sequence; identical to SEQ ID NO: 1431
  Synthetic

SEQ ID NO: 1704 - protein, 44 aa, Artificial Sequence; identical to SEQ ID NO: 1424
  Synthetic

SEQ ID NO: 1705 - protein, 116 aa, Artificial Sequence; identical to SEQ ID NO: 1433
  Synthetic

SEQ ID NO: 1706 - protein, 44 aa, Artificial Sequence; identical to SEQ ID NO: 1424
  Synthetic

SEQ ID NO: 1707 - protein, 116 aa, Artificial Sequence; identical to SEQ ID NO: 1435
  Synthetic

SEQ ID NO: 1708 - protein, 44 aa, Artificial Sequence; identical to SEQ ID NO: 1424
  Synthetic

SEQ ID NO: 1709 - protein, 116 aa, Artificial Sequence; identical to SEQ ID NO: 1437
  Synthetic

SEQ ID NO: 1710 - protein, 44 aa, Artificial Sequence; identical to SEQ ID NO: 1424
  Synthetic

SEQ ID NO: 1711 - protein, 116 aa, Artificial Sequence; identical to SEQ ID NO: 1423
  Synthetic

SEQ ID NO: 1712 - protein, 44 aa, Artificial Sequence; identical to SEQ ID NO: 1424
  Synthetic

SEQ ID NO: 1713 - protein, 116 aa, Artificial Sequence; identical to SEQ ID NO: 1425
  Synthetic

SEQ ID NO: 1714 - protein, 44 aa, Artificial Sequence; identical to SEQ ID NO: 1426
  Synthetic

SEQ ID NO: 1715 - protein, 116 aa, Artificial Sequence; identical to SEQ ID NO: 1425
  Synthetic

SEQ ID NO: 1716 - protein, 44 aa, Artificial Sequence; identical to SEQ ID NO: 1428
  Synthetic

SEQ ID NO: 1717 - protein, 116 aa, Artificial Sequence; identical to SEQ ID NO: 1429
  Synthetic

SEQ ID NO: 1718 - protein, 44 aa, Artificial Sequence; identical to SEQ ID NO: 1424
  Synthetic

SEQ ID NO: 1719 - protein, 116 aa, Artificial Sequence; identical to SEQ ID NO: 1431
  Synthetic

SEQ ID NO: 1720 - protein, 44 aa, Artificial Sequence; identical to SEQ ID NO: 1424
  Synthetic

SEQ ID NO: 1721 - protein, 116 aa, Artificial Sequence; identical to SEQ ID NO: 1433
  Synthetic

SEQ ID NO: 1722 - protein, 44 aa, Artificial Sequence; identical to SEQ ID NO: 1424
  Synthetic

SEQ ID NO: 1723 - protein, 116 aa, Artificial Sequence; identical to SEQ ID NO: 1435
  Synthetic

SEQ ID NO: 1724 - protein, 44 aa, Artificial Sequence; identical to SEQ ID NO: 1424
  Synthetic

SEQ ID NO: 1725 - protein, 116 aa, Artificial Sequence; identical to SEQ ID NO: 1437
  Synthetic

SEQ ID NO: 1726 - protein, 44 aa, Artificial Sequence; identical to SEQ ID NO: 1424
  Synthetic

SEQ ID NO: 1727 - protein, 116 aa, Artificial Sequence; identical to SEQ ID NO: 1423
  Synthetic

SEQ ID NO: 1728 - protein, 44 aa, Artificial Sequence; identical to SEQ ID NO: 1424
  Synthetic

SEQ ID NO: 1729 - protein, 116 aa, Artificial Sequence; identical to SEQ ID NO: 1425
  Synthetic

SEQ ID NO: 1730 - protein, 44 aa, Artificial Sequence; identical to SEQ ID NO: 1426
  Synthetic

SEQ ID NO: 1731 - protein, 116 aa, Artificial Sequence; identical to SEQ ID NO: 1425
  Synthetic

SEQ ID NO: 1732 - protein, 44 aa, Artificial Sequence; identical to SEQ ID NO: 1428
  Synthetic

SEQ ID NO: 1733 - protein, 116 aa, Artificial Sequence; identical to SEQ ID NO: 1429
  Synthetic

SEQ ID NO: 1734 - protein, 44 aa, Artificial Sequence; identical to SEQ ID NO: 1424
  Synthetic

SEQ ID NO: 1735 - protein, 116 aa, Artificial Sequence; identical to SEQ ID NO: 1431
  Synthetic

SEQ ID NO: 1736 - protein, 44 aa, Artificial Sequence; identical to SEQ ID NO: 1424
  Synthetic

SEQ ID NO: 1737 - protein, 116 aa, Artificial Sequence; identical to SEQ ID NO: 1433
  Synthetic

SEQ ID NO: 1738 - protein, 44 aa, Artificial Sequence; identical to SEQ ID NO: 1424
  Synthetic

SEQ ID NO: 1739 - protein, 116 aa, Artificial Sequence; identical to SEQ ID NO: 1435
  Synthetic

SEQ ID NO: 1740 - protein, 44 aa, Artificial Sequence; identical to SEQ ID NO: 1424
  Synthetic

SEQ ID NO: 1741 - protein, 116 aa, Artificial Sequence; identical to SEQ ID NO: 1437
  Synthetic

SEQ ID NO: 1742 - protein, 44 aa, Artificial Sequence; identical to SEQ ID NO: 1424
  Synthetic

SEQ ID NO: 1743 - protein, 116 aa, Artificial Sequence; identical to SEQ ID NO: 1423
  Synthetic

SEQ ID NO: 1744 - protein, 44 aa, Artificial Sequence; identical to SEQ ID NO: 1424
  Synthetic

SEQ ID NO: 1745 - protein, 116 aa, Artificial Sequence; identical to SEQ ID NO: 1433
  Synthetic

SEQ ID NO: 1746 - protein, 116 aa, Artificial Sequence; identical to SEQ ID NO: 1425
  Synthetic

SEQ ID NO: 1747 - protein, 44 aa, Artificial Sequence; identical to SEQ ID NO: 1426
  Synthetic

SEQ ID NO: 1748 - protein, 116 aa, Artificial Sequence; identical to SEQ ID NO: 1429
  Synthetic

SEQ ID NO: 1749 - protein, 44 aa, Artificial Sequence; identical to SEQ ID NO: 1424
  Synthetic

SEQ ID NO: 1750 - protein, 116 aa, Artificial Sequence; identical to SEQ ID NO: 1425
  Synthetic

SEQ ID NO: 1751 - protein, 44 aa, Artificial Sequence; identical to SEQ ID NO: 1428
  Synthetic

SEQ ID NO: 1752 - protein, 116 aa, Artificial Sequence; identical to SEQ ID NO: 1423
  Synthetic

SEQ ID NO: 1753 - protein, 44 aa, Artificial Sequence; identical to SEQ ID NO: 1424
  Synthetic

SEQ ID NO: 1754 - protein, 116 aa, Artificial Sequence; identical to SEQ ID NO: 1429
  Synthetic

SEQ ID NO: 1755 - protein, 44 aa, Artificial Sequence; identical to SEQ ID NO: 1424
  Synthetic

SEQ ID NO: 1756 - protein, 116 aa, Artificial Sequence; identical to SEQ ID NO: 1437
  Synthetic

SEQ ID NO: 1757 - protein, 116 aa, Artificial Sequence; identical to SEQ ID NO: 1431
  Synthetic

SEQ ID NO: 1758 - protein, 44 aa, Artificial Sequence; identical to SEQ ID NO: 1424
  Synthetic

SEQ ID NO: 1759 - protein, 116 aa, Artificial Sequence; identical to SEQ ID NO: 1425
  Synthetic

SEQ ID NO: 1760 - protein, 44 aa, Artificial Sequence; identical to SEQ ID NO: 1426
  Synthetic

SEQ ID NO: 1761 - protein, 116 aa, Artificial Sequence; identical to SEQ ID NO: 1433
  Synthetic

SEQ ID NO: 1762 - protein, 44 aa, Artificial Sequence; identical to SEQ ID NO: 1424
  Synthetic

SEQ ID NO: 1763 - protein, 116 aa, Artificial Sequence; identical to SEQ ID NO: 1435
  Synthetic

SEQ ID NO: 1764 - protein, 116 aa, Artificial Sequence; identical to SEQ ID NO: 1435
  Synthetic

SEQ ID NO: 1765 - protein, 44 aa, Artificial Sequence; identical to SEQ ID NO: 1424
  Synthetic

SEQ ID NO: 1766 - protein, 116 aa, Artificial Sequence; identical to SEQ ID NO: 1431
  Synthetic

SEQ ID NO: 1767 - protein, 116 aa, Artificial Sequence; identical to SEQ ID NO: 1437
  Synthetic

SEQ ID NO: 1768 - protein, 44 aa, Artificial Sequence; identical to SEQ ID NO: 1424
  Synthetic

SEQ ID NO: 1769 - protein, 116 aa, Artificial Sequence; identical to SEQ ID NO: 1425
  Synthetic

SEQ ID NO: 1770 - protein, 44 aa, Artificial Sequence; identical to SEQ ID NO: 1428
  Synthetic

SEQ ID NO: 1771 - protein, 116 aa, Artificial Sequence; identical to SEQ ID NO: 1423
  Synthetic

SEQ ID NO: 1772 - protein, 44 aa, Artificial Sequence; identical to SEQ ID NO: 1424
  Synthetic

SEQ ID NO: 1773 - protein, 116 aa, Artificial Sequence; identical to SEQ ID NO: 1425
  Synthetic

SEQ ID NO: 1774 - protein, 44 aa, Artificial Sequence; identical to SEQ ID NO: 1426
  Synthetic

SEQ ID NO: 1775 - protein, 116 aa, Artificial Sequence; identical to SEQ ID NO: 1425
  Synthetic

SEQ ID NO: 1776 - protein, 44 aa, Artificial Sequence; identical to SEQ ID NO: 1428
  Synthetic

SEQ ID NO: 1777 - protein, 116 aa, Artificial Sequence; identical to SEQ ID NO: 1429
  Synthetic

SEQ ID NO: 1778 - protein, 44 aa, Artificial Sequence; identical to SEQ ID NO: 1424
  Synthetic

SEQ ID NO: 1779 - protein, 116 aa, Artificial Sequence; identical to SEQ ID NO: 1431
  Synthetic

SEQ ID NO: 1780 - protein, 44 aa, Artificial Sequence; identical to SEQ ID NO: 1424
  Synthetic

SEQ ID NO: 1781 - protein, 116 aa, Artificial Sequence; identical to SEQ ID NO: 1433
  Synthetic

SEQ ID NO: 1782 - protein, 44 aa, Artificial Sequence; identical to SEQ ID NO: 1424
  Synthetic

SEQ ID NO: 1783 - protein, 116 aa, Artificial Sequence; identical to SEQ ID NO: 1435
  Synthetic

SEQ ID NO: 1784 - protein, 44 aa, Artificial Sequence; identical to SEQ ID NO: 1424
  Synthetic

SEQ ID NO: 1785 - protein, 116 aa, Artificial Sequence; identical to SEQ ID NO: 1437
  Synthetic

SEQ ID NO: 1786 - protein, 44 aa, Artificial Sequence; identical to SEQ ID NO: 1424
  Synthetic

SEQ ID NO: 1787 - protein, 116 aa, Artificial Sequence; identical to SEQ ID NO: 1423
  Synthetic

SEQ ID NO: 1788 - protein, 44 aa, Artificial Sequence; identical to SEQ ID NO: 1424
  Synthetic

SEQ ID NO: 1789 - protein, 116 aa, Artificial Sequence; identical to SEQ ID NO: 1425
  Synthetic

SEQ ID NO: 1790 - protein, 44 aa, Artificial Sequence; identical to SEQ ID NO: 1426
  Synthetic

SEQ ID NO: 1791 - protein, 116 aa, Artificial Sequence; identical to SEQ ID NO: 1425
  Synthetic

SEQ ID NO: 1792 - protein, 44 aa, Artificial Sequence; identical to SEQ ID NO: 1428
  Synthetic

SEQ ID NO: 1793 - protein, 116 aa, Artificial Sequence; identical to SEQ ID NO: 1429
  Synthetic

SEQ ID NO: 1794 - protein, 44 aa, Artificial Sequence; identical to SEQ ID NO: 1424
  Synthetic

SEQ ID NO: 1795 - protein, 116 aa, Artificial Sequence; identical to SEQ ID NO: 1431
  Synthetic

SEQ ID NO: 1796 - protein, 44 aa, Artificial Sequence; identical to SEQ ID NO: 1424
  Synthetic

SEQ ID NO: 1797 - protein, 116 aa, Artificial Sequence; identical to SEQ ID NO: 1433
  Synthetic

SEQ ID NO: 1798 - protein, 44 aa, Artificial Sequence; identical to SEQ ID NO: 1424
  Synthetic

SEQ ID NO: 1799 - protein, 116 aa, Artificial Sequence; identical to SEQ ID NO: 1435
  Synthetic

SEQ ID NO: 1800 - protein, 44 aa, Artificial Sequence; identical to SEQ ID NO: 1424
  Synthetic

SEQ ID NO: 1801 - protein, 116 aa, Artificial Sequence; identical to SEQ ID NO: 1437
  Synthetic

SEQ ID NO: 1802 - protein, 44 aa, Artificial Sequence; identical to SEQ ID NO: 1424
  Synthetic

SEQ ID NO: 1803 - protein, 116 aa, Artificial Sequence; identical to SEQ ID NO: 1423
  Synthetic

SEQ ID NO: 1804 - protein, 44 aa, Artificial Sequence; identical to SEQ ID NO: 1424
  Synthetic

SEQ ID NO: 1805 - protein, 116 aa, Artificial Sequence; identical to SEQ ID NO: 1425
  Synthetic

SEQ ID NO: 1806 - protein, 44 aa, Artificial Sequence; identical to SEQ ID NO: 1426
  Synthetic

SEQ ID NO: 1807 - protein, 116 aa, Artificial Sequence; identical to SEQ ID NO: 1425
  Synthetic

SEQ ID NO: 1808 - protein, 44 aa, Artificial Sequence; identical to SEQ ID NO: 1428
  Synthetic

SEQ ID NO: 1809 - protein, 116 aa, Artificial Sequence; identical to SEQ ID NO: 1429
  Synthetic

SEQ ID NO: 1810 - protein, 44 aa, Artificial Sequence; identical to SEQ ID NO: 1424
  Synthetic

SEQ ID NO: 1811 - protein, 116 aa, Artificial Sequence; identical to SEQ ID NO: 1431
  Synthetic

SEQ ID NO: 1812 - protein, 44 aa, Artificial Sequence; identical to SEQ ID NO: 1424
  Synthetic

SEQ ID NO: 1813 - protein, 116 aa, Artificial Sequence; identical to SEQ ID NO: 1433
  Synthetic

SEQ ID NO: 1814 - protein, 44 aa, Artificial Sequence; identical to SEQ ID NO: 1424
  Synthetic

SEQ ID NO: 1815 - protein, 116 aa, Artificial Sequence; identical to SEQ ID NO: 1435
  Synthetic

SEQ ID NO: 1816 - protein, 44 aa, Artificial Sequence; identical to SEQ ID NO: 1424
  Synthetic

SEQ ID NO: 1817 - protein, 116 aa, Artificial Sequence; identical to SEQ ID NO: 1437
  Synthetic

SEQ ID NO: 1818 - protein, 44 aa, Artificial Sequence; identical to SEQ ID NO: 1424
  Synthetic

SEQ ID NO: 1819 - protein, 116 aa, Artificial Sequence; identical to SEQ ID NO: 1423
  Synthetic

SEQ ID NO: 1820 - protein, 44 aa, Artificial Sequence; identical to SEQ ID NO: 1424
  Synthetic

SEQ ID NO: 1821 - protein, 116 aa, Artificial Sequence; identical to SEQ ID NO: 1425
  Synthetic

SEQ ID NO: 1822 - protein, 44 aa, Artificial Sequence; identical to SEQ ID NO: 1426
  Synthetic

SEQ ID NO: 1823 - protein, 116 aa, Artificial Sequence; identical to SEQ ID NO: 1425
  Synthetic

SEQ ID NO: 1824 - protein, 44 aa, Artificial Sequence; identical to SEQ ID NO: 1428
  Synthetic

SEQ ID NO: 1825 - protein, 116 aa, Artificial Sequence; identical to SEQ ID NO: 1429
  Synthetic

SEQ ID NO: 1826 - protein, 44 aa, Artificial Sequence; identical to SEQ ID NO: 1424
  Synthetic

SEQ ID NO: 1827 - protein, 116 aa, Artificial Sequence; identical to SEQ ID NO: 1431
  Synthetic

SEQ ID NO: 1828 - protein, 44 aa, Artificial Sequence; identical to SEQ ID NO: 1424
  Synthetic

SEQ ID NO: 1829 - protein, 116 aa, Artificial Sequence; identical to SEQ ID NO: 1433
  Synthetic

SEQ ID NO: 1830 - protein, 44 aa, Artificial Sequence; identical to SEQ ID NO: 1424
  Synthetic

SEQ ID NO: 1831 - protein, 116 aa, Artificial Sequence; identical to SEQ ID NO: 1435
  Synthetic

SEQ ID NO: 1832 - protein, 44 aa, Artificial Sequence; identical to SEQ ID NO: 1424
  Synthetic

SEQ ID NO: 1833 - protein, 116 aa, Artificial Sequence; identical to SEQ ID NO: 1437
  Synthetic

SEQ ID NO: 1834 - protein, 44 aa, Artificial Sequence; identical to SEQ ID NO: 1424
  Synthetic

SEQ ID NO: 1835 - protein, 116 aa, Artificial Sequence; identical to SEQ ID NO: 1423
  Synthetic

SEQ ID NO: 1836 - protein, 44 aa, Artificial Sequence; identical to SEQ ID NO: 1424
  Synthetic

SEQ ID NO: 1837 - protein, 116 aa, Artificial Sequence; identical to SEQ ID NO: 1425
  Synthetic

SEQ ID NO: 1838 - protein, 44 aa, Artificial Sequence; identical to SEQ ID NO: 1426
  Synthetic

SEQ ID NO: 1839 - protein, 116 aa, Artificial Sequence; identical to SEQ ID NO: 1425
  Synthetic

SEQ ID NO: 1840 - protein, 44 aa, Artificial Sequence; identical to SEQ ID NO: 1428
  Synthetic

SEQ ID NO: 1841 - protein, 116 aa, Artificial Sequence; identical to SEQ ID NO: 1429
  Synthetic

SEQ ID NO: 1842 - protein, 44 aa, Artificial Sequence; identical to SEQ ID NO: 1424
  Synthetic

SEQ ID NO: 1843 - protein, 116 aa, Artificial Sequence; identical to SEQ ID NO: 1431
  Synthetic

SEQ ID NO: 1844 - protein, 44 aa, Artificial Sequence; identical to SEQ ID NO: 1424
  Synthetic

SEQ ID NO: 1845 - protein, 116 aa, Artificial Sequence; identical to SEQ ID NO: 1433
  Synthetic

SEQ ID NO: 1846 - protein, 44 aa, Artificial Sequence; identical to SEQ ID NO: 1424
  Synthetic

SEQ ID NO: 1847 - protein, 116 aa, Artificial Sequence; identical to SEQ ID NO: 1435
  Synthetic

SEQ ID NO: 1848 - protein, 44 aa, Artificial Sequence; identical to SEQ ID NO: 1424
  Synthetic

SEQ ID NO: 1849 - protein, 116 aa, Artificial Sequence; identical to SEQ ID NO: 1437
  Synthetic

SEQ ID NO: 1850 - protein, 44 aa, Artificial Sequence; identical to SEQ ID NO: 1424
  Synthetic

SEQ ID NO: 1851 - protein, 116 aa, Artificial Sequence; identical to SEQ ID NO: 1423
  Synthetic

SEQ ID NO: 1852 - protein, 44 aa, Artificial Sequence; identical to SEQ ID NO: 1424
  Synthetic

SEQ ID NO: 1853 - protein, 116 aa, Artificial Sequence; identical to SEQ ID NO: 1425
  Synthetic

SEQ ID NO: 1854 - protein, 44 aa, Artificial Sequence; identical to SEQ ID NO: 1426
  Synthetic

SEQ ID NO: 1855 - protein, 116 aa, Artificial Sequence; identical to SEQ ID NO: 1425
  Synthetic

SEQ ID NO: 1856 - protein, 44 aa, Artificial Sequence; identical to SEQ ID NO: 1428
  Synthetic

SEQ ID NO: 1857 - protein, 116 aa, Artificial Sequence; identical to SEQ ID NO: 1429
  Synthetic

SEQ ID NO: 1858 - protein, 44 aa, Artificial Sequence; identical to SEQ ID NO: 1424
  Synthetic

SEQ ID NO: 1859 - protein, 116 aa, Artificial Sequence; identical to SEQ ID NO: 1431
  Synthetic

SEQ ID NO: 1860 - protein, 44 aa, Artificial Sequence; identical to SEQ ID NO: 1424
  Synthetic

SEQ ID NO: 1861 - protein, 116 aa, Artificial Sequence; identical to SEQ ID NO: 1433
  Synthetic

SEQ ID NO: 1862 - protein, 44 aa, Artificial Sequence; identical to SEQ ID NO: 1424
  Synthetic

SEQ ID NO: 1863 - protein, 116 aa, Artificial Sequence; identical to SEQ ID NO: 1435
  Synthetic

SEQ ID NO: 1864 - protein, 44 aa, Artificial Sequence; identical to SEQ ID NO: 1424
  Synthetic

SEQ ID NO: 1865 - protein, 116 aa, Artificial Sequence; identical to SEQ ID NO: 1437
  Synthetic

SEQ ID NO: 1866 - protein, 44 aa, Artificial Sequence; identical to SEQ ID NO: 1424
  Synthetic

SEQ ID NO: 1867 - protein, 116 aa, Artificial Sequence; identical to SEQ ID NO: 1423
  Synthetic

SEQ ID NO: 1868 - protein, 44 aa, Artificial Sequence; identical to SEQ ID NO: 1424
  Synthetic

SEQ ID NO: 1869 - protein, 116 aa, Artificial Sequence; identical to SEQ ID NO: 1425
  Synthetic

SEQ ID NO: 1870 - protein, 44 aa, Artificial Sequence; identical to SEQ ID NO: 1426
  Synthetic

SEQ ID NO: 1871 - protein, 116 aa, Artificial Sequence; identical to SEQ ID NO: 1425
  Synthetic

SEQ ID NO: 1872 - protein, 44 aa, Artificial Sequence; identical to SEQ ID NO: 1428
  Synthetic

SEQ ID NO: 1873 - protein, 116 aa, Artificial Sequence; identical to SEQ ID NO: 1429
  Synthetic

SEQ ID NO: 1874 - protein, 44 aa, Artificial Sequence; identical to SEQ ID NO: 1424
  Synthetic

SEQ ID NO: 1875 - protein, 116 aa, Artificial Sequence; identical to SEQ ID NO: 1431
  Synthetic

SEQ ID NO: 1876 - protein, 44 aa, Artificial Sequence; identical to SEQ ID NO: 1424
  Synthetic

SEQ ID NO: 1877 - protein, 116 aa, Artificial Sequence; identical to SEQ ID NO: 1433
  Synthetic

SEQ ID NO: 1878 - protein, 44 aa, Artificial Sequence; identical to SEQ ID NO: 1424
  Synthetic

SEQ ID NO: 1879 - protein, 116 aa, Artificial Sequence; identical to SEQ ID NO: 1435
  Synthetic

SEQ ID NO: 1880 - protein, 44 aa, Artificial Sequence; identical to SEQ ID NO: 1424
  Synthetic

SEQ ID NO: 1881 - protein, 116 aa, Artificial Sequence; identical to SEQ ID NO: 1437
  Synthetic

SEQ ID NO: 1882 - protein, 44 aa, Artificial Sequence; identical to SEQ ID NO: 1424
  Synthetic

SEQ ID NO: 1883 - protein, 449 aa, Artificial Sequence
  Synthetic
EVQVLESGGGLVQPGESLRLSCTASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1884 - DNA, 1416 bp, Artificial Sequence
  Synthetic
atggacatgagggtgcccgctcagctcctggggctcctgctgctgtggctgagaggtgcgcgctgtgaggtgcaggtgttggagtctgggggaggcttggtacagcctggggagtccctgagactctcctgtacagcctctggattcacctttaacgcctatgccatgagctgggtccgccaggctccagggaaggggctggagtgggtgtcaactattagtggtagtggtagtaccacatactacgcagactccgtgaagggccggttcaccatctccagagacaattccaagaacacgctggatctgcaaatgaacagcctgagagccgcggacacggccgtatattactgtgcgaaagttgctggaagtaactttttctttgaccactggggccagggaaccctggttaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1885 - protein, 452 aa, Artificial Sequence
  Synthetic
QVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1886 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1887 - protein, 451 aa, Artificial Sequence
  Synthetic
QVQLVQSGAEVKKPGASVKVSCKASGYTFNGYYIHWVRQAPGQGLEWMGWLNPNSGGANYAQKFQGWVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1888 - DNA, 1422 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggctgggtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1889 - protein, 449 aa, Artificial Sequence
  Synthetic
EVQLLESGGGLVQPGGSLRLSCAASGFTFSTYAMNWVRQAPGKGLEWVSTVSGSGRPTYYADSVKGRFTISRDNSKNTLYLQMNSLRAEDTAVYYCAKAYYSNYLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1890 - DNA, 1416 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcacctatgccatgaactgggtccgccaggctccagggaaggggctggagtgggtgtcaactgttagtggtagtggtcgtcccacatactacgcagactccgtgaagggccggttcaccatctccagagacaattccaagaacacgctgtatctgcaaatgaacagcctgagagccgaggacacggccgtttattactgtgcgaaggcctactacagtaactacctttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1891 - protein, 449 aa, Artificial Sequence
  Synthetic
EVQLLESGGGMVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1892 - DNA, 1416 bp, Artificial Sequence
  Synthetic
atggacatgagggtgcccgctcagctcctggggctcctgctgctgtggctgagaggtgcgcgctgtgaggtgcagctgttggagtctgggggaggcatggtacagccgggggggtccctgagactctcctgtgcagtctctggattcacctttagtcgctatgccatgagctgggtccgccaggctccagggaaggggctggagtgggtgtcagaaatgaggggtagtagtggtagcacatactacgcagactccgtgaagggccggttcaccatctccagagacaattccaagaacacgctgtatctgcaaatgaacagcctgagagtcgaggacacggccatctattactgtgcgaaagaatttagcagcaactccctctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1893 - protein, 446 aa, Artificial Sequence
  Synthetic
EVQLVESGGGLVQPGGSLRLSCAASGFTFSSNWMSWVRQAPGKGLDWMASMKQDGSEIYYVDSVKGRFTISRDNAKNSLHLQMNSLRAEDTAVYYCVRGGWRFESWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1894 - DNA, 1407 bp, Artificial Sequence
  Synthetic
atggacatgagggtgcccgctcagctcctggggctcctgctgctgtggctgagaggtgcgcgctgtgaggtgcagctggtggagtctgggggaggcttggtccagcctggggggtccctgagactctcctgtgcagcctctggattcacctttagcagcaattggatgagctgggtccgccaggctccagggaaggggctggactggatggccagcatgaagcaagatggaagtgagatctactatgtggactctgtgaagggccgattcaccatctccagagacaacgccaagaactcactgcatctgcaaatgaacagcctgagagccgaggacacggctgtgtattactgtgtgagaggagggtggagatttgagtcctggggccagggagccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1895 - protein, 447 aa, Artificial Sequence
  Synthetic
EVQLVESGGGLVQPGGSLRLSCAASGFTFSSYWMSWVRQAPGKGLEWVANIKQDGSEEYYVDSVKGRFTISRDNAKNSLFLQMNSLRAEDTAVYYCARDYGDSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1896 - DNA, 1410 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtttctgcaaatgaacagcctgagagccgaggacacggctgtgtattactgtgcgagagactacggtgactcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1897 - protein, 452 aa, Artificial Sequence
  Synthetic
QVQLVQSGAEVKKPGASVKVSCKASGYTFTRYDINWVRQATGQGLEWMGWLNPNSGNTGQTQKFRGRVTMTRDTSINTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1898 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatcaatacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1899 - protein, 449 aa, Artificial Sequence
  Synthetic
EVQLLESGGGLVQPGGSLRLSCAASGFTFSSYAMTWVRQAPGRGLQWVSTISGSGSNTYYADSVKGRFTISRDNSKNTLYLQMSSLRAEDTAVYYCAKEGGSNRYFHHWGQGTLVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1900 - DNA, 1416 bp, Artificial Sequence
  Synthetic
atggacatgagggtgcccgctcagctcctggggctcctgctgctgtggctgagaggtgcgcgctgtgaggtgcagctgttggagtctgggggaggcttggtacagcctggggggtccctgagactctcctgtgcagcctctggattcacctttagcagctatgccatgacctgggtccgccaggctccagggagggggctgcagtgggtgtcaactattagtggtagtggtagtaacacatactacgcagactccgtgaagggccggttcaccatctccagagacaattccaagaacacgctgtatctgcaaatgagcagcctgagagccgaggacacggccgtatattactgtgcgaaagaggggggcagtaaccgatacttccaccactggggccagggcaccctggtcaccatctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1901 - protein, 452 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1902 - DNA, 1425 bp, Artificial Sequence
  Synthetic
atggacatgagggtgcccgctcagctcctggggctcctgctgctgtggctgagaggtgcgcgctgtcaggtgcaactggtgcagtctggggctgaggtgacgaagcctggggcctcagtgaaggtgtcctgcaaggcttctggatacaccttcaccagatatgatatcaactgggtgcgacaggccactggacaagggcttgagtggatgggatggatgaaccctaacagtggtaattcaggctctgtacagaaattccggggcagagtcaccatgaccagggacacctccatcaccacagtctatatggaactgagcagcctgagatctgatgacacggccgtgtattactgtgcgagaggaggaattagcagcagctggcactgggcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1903 - protein, 453 aa, Artificial Sequence
  Synthetic
QVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1904 - DNA, 1428 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1905 - protein, 452 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1906 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggaaggatgaaccctaagagtggtaatgcaggctatgtacagaacttccggggcagagtcaccatgaccagggacacctccatcagcacagcctacatggagctgagcagcctgagatctgaggacacggccgtgtattactgtgcgagaggcgggcgtaccagcatctggtccttcgtctttgattactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1907 - protein, 454 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1908 - DNA, 1431 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaactgggtgcgacaggccactggacaagggcttgagtggatgggatggatgaaccctaacaggggtaacacaggctatgtaaagaagttccagggcagagtcaccatgaccagggacacctccatcagcacagcctacatggagctgagtagtctgagatctgaggacacggccgtgtattactgtgcgagaaggagggccgtgtatcgcagcagctgggagtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1909 - protein, 452 aa, Artificial Sequence
  Synthetic
QVQLVQSGAEVKKPGASVKVSCKASGYTFTGYYMHWVRQAPGQGLEWMGWFKPNSGVTNYAQKFQGRVTMSRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1910 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgagcagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1911 - protein, 452 aa, Artificial Sequence; identical to SEQ ID NO: 1885
  Synthetic

SEQ ID NO: 1912 - DNA, 1425 bp, Artificial Sequence; identical to SEQ ID NO: 1886
  Synthetic

SEQ ID NO: 1913 - protein, 449 aa, Artificial Sequence; identical to SEQ ID NO: 1889
  Synthetic

SEQ ID NO: 1914 - DNA, 1416 bp, Artificial Sequence; identical to SEQ ID NO: 1890
  Synthetic

SEQ ID NO: 1915 - protein, 447 aa, Artificial Sequence; identical to SEQ ID NO: 1895
  Synthetic

SEQ ID NO: 1916 - DNA, 1410 bp, Artificial Sequence; identical to SEQ ID NO: 1896
  Synthetic

SEQ ID NO: 1917 - protein, 452 aa, Artificial Sequence; identical to SEQ ID NO: 1897
  Synthetic

SEQ ID NO: 1918 - DNA, 1425 bp, Artificial Sequence; identical to SEQ ID NO: 1898
  Synthetic

SEQ ID NO: 1919 - protein, 453 aa, Artificial Sequence; identical to SEQ ID NO: 1903
  Synthetic

SEQ ID NO: 1920 - DNA, 1428 bp, Artificial Sequence; identical to SEQ ID NO: 1904
  Synthetic

SEQ ID NO: 1921 - protein, 454 aa, Artificial Sequence; identical to SEQ ID NO: 1907
  Synthetic

SEQ ID NO: 1922 - DNA, 1431 bp, Artificial Sequence; identical to SEQ ID NO: 1908
  Synthetic

SEQ ID NO: 1923 - protein, 452 aa, Artificial Sequence; identical to SEQ ID NO: 1909
  Synthetic

SEQ ID NO: 1924 - DNA, 1425 bp, Artificial Sequence; identical to SEQ ID NO: 1910
  Synthetic

SEQ ID NO: 1925 - protein, 452 aa, Artificial Sequence
  Synthetic
QVQLVQSGAEVKKPGASVKVSCKASGYTFTRYDINWVRQATGQGLEWMGWLNPNSGNTGQTQKFRGRVTMTRDTSISTAYMELSSLRSEDTAVYYCARGGYTSAWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1926 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcacccgttatgatatcaactgggtgcgacaggccactggacaagggcttgagtggatgggatggctgaaccctaatagtggtaacacaggccagacacagaagttccggggcagagtcaccatgaccagggacacctccatctctacagcctacatggagctgagcagcctgagatctgaggacacggccgtgtattactgtgcgagaggggggtataccagtgcctggagatggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1927 - protein, 452 aa, Artificial Sequence; identical to SEQ ID NO: 1897
  Synthetic

SEQ ID NO: 1928 - DNA, 1425 bp, Artificial Sequence; identical to SEQ ID NO: 1898
  Synthetic

SEQ ID NO: 1929 - protein, 452 aa, Artificial Sequence
  Synthetic
QVQLVQSGAEVKKPGASVKVSCKASGYTFTGYYMHWVRQAPGQGLEWMGWFKPNSGVTNYAQKFQGRVTMTRDTSISTAYMELSSLRSDDTAVYYCARAGYSTSYKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1930 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgactagggacacgtccatcagcacagcctacatggagctgagcagcctgagatctgacgacacggccgtgtattactgtgcgagagccggatacagcaccagttataaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1931 - protein, 452 aa, Artificial Sequence
  Synthetic
QVQLVQSGAEVKKPGASVKVSCKASGYTFTGYYMHWVRQAPGQGLEWMGWFKPNSGVTNYAQKFQGRVTMTRDTSISTAYMELSSLRSDDTAVYYCARAGYSTSHKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1932 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgactagggacacgtccatcagcacagcctacatggagctgagcagcctgagatctgacgacacggccgtgtattactgtgcgagagccggatacagcaccagtcataaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1933 - protein, 452 aa, Artificial Sequence
  Synthetic
QVQLVQSGAEVKKPGASVKVSCKASGYTFTGYYMHWVRQAPGQGLEWMGWFKPNSGVTNYAQKFQGRVTMTRDTSISTAYMELSSLRSDDTAVYYCARAGYSTSFKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1934 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgactagggacacgtccatcagcacagcctacatggagctgagcagcctgagatctgacgacacggccgtgtattactgtgcgagagccggatacagcaccagttttaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1935 - protein, 452 aa, Artificial Sequence
  Synthetic
QVQLVQSGAEVKKPGASVKVSCKASGYTFTGYYMHWVRQAPGQGLEWMGWFKPNSGVTNYAQKFQGRVTMTRDTSISTAYMELSSLRSDDTAVYYCARAGYSTSWKDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1936 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccggctactatatgcactgggtgcgacaggcccctggacaagggcttgagtggatgggatggttcaaacctaatagtggtgtcacaaactatgcacagaagtttcagggcagggtcaccatgactagggacacgtccatcagcacagcctacatggagctgagcagcctgagatctgacgacacggccgtgtattactgtgcgagagccggatacagcaccagttggaaagactggttcgacccctggggccagggaaccctggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1937 - protein, 452 aa, Artificial Sequence; identical to SEQ ID NO: 1935
  Synthetic

SEQ ID NO: 1938 - DNA, 1425 bp, Artificial Sequence; identical to SEQ ID NO: 1936
  Synthetic

SEQ ID NO: 1939 - protein, 454 aa, Artificial Sequence; identical to SEQ ID NO: 1907
  Synthetic

SEQ ID NO: 1940 - DNA, 1431 bp, Artificial Sequence; identical to SEQ ID NO: 1908
  Synthetic

SEQ ID NO: 1941 - protein, 454 aa, Artificial Sequence; identical to SEQ ID NO: 1907
  Synthetic

SEQ ID NO: 1942 - DNA, 1431 bp, Artificial Sequence; identical to SEQ ID NO: 1908
  Synthetic

SEQ ID NO: 1943 - protein, 454 aa, Artificial Sequence; identical to SEQ ID NO: 1907
  Synthetic

SEQ ID NO: 1944 - DNA, 1431 bp, Artificial Sequence; identical to SEQ ID NO: 1908
  Synthetic

SEQ ID NO: 1945 - protein, 453 aa, Artificial Sequence
  Synthetic
QVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAYKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1946 - DNA, 1428 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctataagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1947 - protein, 453 aa, Artificial Sequence; identical to SEQ ID NO: 1945
  Synthetic

SEQ ID NO: 1948 - DNA, 1428 bp, Artificial Sequence; identical to SEQ ID NO: 1946
  Synthetic

SEQ ID NO: 1949 - protein, 453 aa, Artificial Sequence
  Synthetic
QVQLVQSGAEVKKPGASVKVSCKASGYTFTSYDINWVRQATGQGLEWMGWMNPNSGNSGSVKKFRDRVTMTRDTSISTAYMELSSLRSEDTAVYYCVRLIGYSSAFKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1950 - DNA, 1428 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccatcagcactgcctacatggaattgagcagcctgagatctgaggacacggccgtgtattactgtgtgagacttatcgggtatagcagtgcctttaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1951 - protein, 453 aa, Artificial Sequence; identical to SEQ ID NO: 1949
  Synthetic

SEQ ID NO: 1952 - DNA, 1428 bp, Artificial Sequence; identical to SEQ ID NO: 1950
  Synthetic

SEQ ID NO: 1953 - protein, 453 aa, Artificial Sequence
  Synthetic
QVQLVQSGAEVKKPGASVKVSCKASGYTFTSYDINWVRQATGQGLEWMGWMNPNSGNSGSVKKFRDRVTMTRDTSTSTAYMELSSLRSEDTAVYYCVRLIGYSSAYKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1954 - DNA, 1428 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccactagcactgcctacatggaattgagcagcctgagatctgaggacacggccgtgtattactgtgtgagacttatcgggtatagcagtgcctataagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1955 - protein, 453 aa, Artificial Sequence
  Synthetic
QVQLVQSGAEVKKPGASVKVSCKASGYTFTSYDINWVRQATGQGLEWMGWMNPNSGNSGSVKKFRDRVTMTRDTSTSTAYMELSSLRSEDTAVYYCVRLIGYSSAWKWSFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1956 - DNA, 1428 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagttatgatatcaattgggtgcgacaggccactggacaagggcttgagtggatgggatggatgaaccctaacagtggtaactcaggctctgtaaagaagttccgggacagagtcaccatgaccagggacacctccactagcactgcctacatggaattgagcagcctgagatctgaggacacggccgtgtattactgtgtgagacttatcgggtatagcagtgcctggaagtggtccttccagcactggggccagggcaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1957 - protein, 453 aa, Artificial Sequence; identical to SEQ ID NO: 1903
  Synthetic

SEQ ID NO: 1958 - DNA, 1428 bp, Artificial Sequence; identical to SEQ ID NO: 1904
  Synthetic

SEQ ID NO: 1959 - protein, 453 aa, Artificial Sequence; identical to SEQ ID NO: 1903
  Synthetic

SEQ ID NO: 1960 - DNA, 1428 bp, Artificial Sequence; identical to SEQ ID NO: 1904
  Synthetic

SEQ ID NO: 1961 - protein, 447 aa, Artificial Sequence
  Synthetic
EVQLVESGGGLVQPGGSLRLSCAASGFTFSSYWMSWVRQAPGKGLEWVANIKQDGSEEYYVDSVKGRFTISRDNAKNSLYLQMNSLRAEDTAVYYCARDYGDVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1962 - DNA, 1410 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtatctgcaaatgaacagcctgagagccgaggacacggctgtgtattactgtgcgagagactacggtgacgtttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1963 - protein, 447 aa, Artificial Sequence
  Synthetic
EVQLVESGGGLVQPGGSLRLSCAASGFTFSSYWMSWVRQAPGKGLEWVANIKQDGSEEYYVDSVKGRFTISRDNAKNSLYLQMNSLRAEDTAVYYCARDYGDAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1964 - DNA, 1410 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtatctgcaaatgaacagcctgagagccgaggacacggctgtgtattactgtgcgagagactacggtgacgcttttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1965 - protein, 447 aa, Artificial Sequence
  Synthetic
EVQLVESGGGLVQPGGSLRLSCAASGFTFSSYWMSWVRQAPGKGLEWVANIKQDGSEEYYVDSVKGRFTISRDNAKNSLYLQMNSLRAEDTAVYYCARDYGESFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1966 - DNA, 1410 bp, Artificial Sequence
  Synthetic
atggacatgagggtgcccgctcagctcctggggctcctgctgctgtggctgagaggtgcgcgctgtgaggtgcagctggtggagtctgggggaggcttggtccagccgggggggtccctgagactctcctgtgcagcctctggattcacctttagtagctattggatgagctgggtccgccaggctccagggaaggggctggagtgggtggccaacatcaagcaagatggaagtgaggaatattatgtggactctgtgaagggccgattcaccatctccagagacaacgccaagaactcactgtatctgcaaatgaacagcctgagagccgaggacacggctgtgtattactgtgcgagagactacggtgaatcctttgactactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1967 - protein, 452 aa, Artificial Sequence
  Synthetic
QVQLVQSGAEVKKPGASVKVSCKASGYTFTRYDINWVRQAPGQGLEWMGWMNPNSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1968 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggcccctggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1969 - protein, 452 aa, Artificial Sequence
  Synthetic
QVQLVQSGAEVKKPGASVKVSCKASGYTFTRYDINWVRQATGQGLEWMGWMNPNSGNAGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1970 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaacgctggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1971 - protein, 452 aa, Artificial Sequence
  Synthetic
QVQLVQSGAEVKKPGASVKVSCKASGYTFTRYDINWVRQATGQGLEWMGWMNPNAGNAGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1972 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacgctggtaacgctggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1973 - protein, 452 aa, Artificial Sequence
  Synthetic
QVQLVQSGAEVKKPGASVKVSCKASGYTFTRYDINWVRQATGQGLEWMGWMNPNAGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1974 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacgctggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1975 - protein, 452 aa, Artificial Sequence
  Synthetic
QVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRYYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1976 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtattacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1977 - protein, 452 aa, Artificial Sequence
  Synthetic
QVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRHYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1978 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggcattacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1979 - protein, 452 aa, Artificial Sequence
  Synthetic
QVQLVQSGAEVKKPGASVKVSCKASGYTFTRYDINWVRQATGQGLEWMGWMNPNSGNSGSVQKFRGRVTMTRDTSIHIAYMELSSLRSEDTAVYYCARGGYTSSWRFYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1980 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggttttacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1981 - protein, 452 aa, Artificial Sequence; identical to SEQ ID NO: 1885
  Synthetic

SEQ ID NO: 1982 - DNA, 1425 bp, Artificial Sequence; identical to SEQ ID NO: 1886
  Synthetic

SEQ ID NO: 1983 - protein, 452 aa, Artificial Sequence
  Synthetic
QVQLVQSGAEVKKPGASVKVSCKASGYTFTRYDINWVRQATGQGLEWMGWMNPNSGQSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1984 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctaacagtggtcaatcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1985 - protein, 452 aa, Artificial Sequence
  Synthetic
QVQLVQSGAEVKKPGASVKVSCKASGYTFTRYDINWVRQATGQGLEWMGWMNPQSGNSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1986 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctcaaagtggtaactcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1987 - protein, 452 aa, Artificial Sequence
  Synthetic
QVQLVQSGAEVKKPGASVKVSCKASGYTFTRYDINWVRQATGQGLEWMGWMNPQSGQSGSVQKFRGRVTMTRDTSIHIAYMELSSLRSEDTAVYYCARGGYTSSWRWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1988 - DNA, 1425 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaccagatatgatatcaactgggtgcgacaggccactggacaaggacttgagtggatgggatggatgaaccctcaaagtggtcaatcaggctctgtacagaagttccggggcagagtcaccatgaccagggacacctccatccacatcgcctacatggaactgagcagcctgagatctgaggacacggccgtgtattactgtgcgagaggcgggtataccagcagctggcggtggtacttcgatctctggggccgtggcaccctggtcactgtctcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1989 - protein, 451 aa, Artificial Sequence
  Synthetic
QVQLVQSGAEVKKPGASVKVSCKASGYTFNGYYIHWVRQAPGQGLEWMGWLNPNSGGANYAQKFQGRVTMTRDTSISTAYMELSRLRSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1990 - DNA, 1422 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggccgtgtcaccatgaccagggacacgtccatcagcacagcctacatggagctgagcaggctgcgttctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1991 - protein, 451 aa, Artificial Sequence; identical to SEQ ID NO: 1989
  Synthetic

SEQ ID NO: 1992 - DNA, 1422 bp, Artificial Sequence; identical to SEQ ID NO: 1990
  Synthetic

SEQ ID NO: 1993 - protein, 451 aa, Artificial Sequence; identical to SEQ ID NO: 1989
  Synthetic

SEQ ID NO: 1994 - DNA, 1422 bp, Artificial Sequence; identical to SEQ ID NO: 1990
  Synthetic

SEQ ID NO: 1995 - protein, 451 aa, Artificial Sequence; identical to SEQ ID NO: 1989
  Synthetic

SEQ ID NO: 1996 - DNA, 1422 bp, Artificial Sequence; identical to SEQ ID NO: 1990
  Synthetic

SEQ ID NO: 1997 - protein, 451 aa, Artificial Sequence
  Synthetic
QVQLVQSGAEVKKPGASVKVSCKASGYTFNGYYIHWVRQAPGQGLEWMGWLNPNSGGANYAQKFQGRVTMTRDTSISTAYMELSRLTSDDTAVYYCARDQRKTTVTPFEYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1998 - DNA, 1422 bp, Artificial Sequence
  Synthetic
atggacatgagggtgcccgctcagctcctggggctcctgctgctgtggctgagaggtgcgcgctgtcaggtgcagctggtgcagtctggggctgaggtgaagaagcctggggcctcagtgaaggtgtcctgcaaggcttctggatacaccttcaacggctactatatccactgggtgcgacaggcccctggacaagggcttgagtggatgggatggctcaacccaaacagtggtggcgcaaactatgcacagaagtttcagggccgtgtcaccatgaccagggacacgtccatcagcacagcctacatggagctgagcaggctgacatctgacgacacggccgtgtattactgtgcgagagatcagaggaagaccacggtgactccctttgagtactggggccagggaaccctggtcaccgtgtcctcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggcaaatag

SEQ ID NO: 1999 - protein, 449 aa, Artificial Sequence; identical to SEQ ID NO: 1889
  Synthetic

SEQ ID NO: 2000 - DNA, 1416 bp, Artificial Sequence; identical to SEQ ID NO: 1890
  Synthetic

SEQ ID NO: 2001 - protein, 449 aa, Artificial Sequence; identical to SEQ ID NO: 1889
  Synthetic

SEQ ID NO: 2002 - DNA, 1416 bp, Artificial Sequence; identical to SEQ ID NO: 1890
  Synthetic

SEQ ID NO: 2003 - protein, 449 aa, Artificial Sequence; identical to SEQ ID NO: 1889
  Synthetic

SEQ ID NO: 2004 - DNA, 1416 bp, Artificial Sequence; identical to SEQ ID NO: 1890
  Synthetic

SEQ ID NO: 2005 - protein, 449 aa, Artificial Sequence; identical to SEQ ID NO: 1889
  Synthetic

SEQ ID NO: 2006 - DNA, 1416 bp, Artificial Sequence; identical to SEQ ID NO: 1890
  Synthetic

SEQ ID NO: 2007 - protein, 449 aa, Artificial Sequence; identical to SEQ ID NO: 1889
  Synthetic

SEQ ID NO: 2008 - DNA, 1416 bp, Artificial Sequence; identical to SEQ ID NO: 1890
  Synthetic

SEQ ID NO: 2009 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHYPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2010 - protein, 214 aa, Artificial Sequence
  Synthetic
DIQMTQSPSSLSASVGDRVTITCQASQDINNHLNWYQQKPGKAPKLLIYGAYTLETGVPSRFSGSGSGTDFTFTISSLQPEDIATYYCQQYDKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2011 - protein, 449 aa, Artificial Sequence
  Synthetic
EVQVLESGGGLVQPGGSLRLSCAASGFTFNAYAMSWVRQAPGKGLEWVSTISGSGSTTYYADSVKGRFTISRDNSKNTLDLQMNSLRAADTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2012 - DNA, 1416 bp, Artificial Sequence; identical to SEQ ID NO: 1884
  Synthetic

SEQ ID NO: 2013 - protein, 449 aa, Artificial Sequence; identical to SEQ ID NO: 2011
  Synthetic

SEQ ID NO: 2014 - DNA, 1416 bp, Artificial Sequence; identical to SEQ ID NO: 1884
  Synthetic

SEQ ID NO: 2015 - protein, 449 aa, Artificial Sequence; identical to SEQ ID NO: 2011
  Synthetic

SEQ ID NO: 2016 - DNA, 1416 bp, Artificial Sequence; identical to SEQ ID NO: 1884
  Synthetic

SEQ ID NO: 2017 - protein, 449 aa, Artificial Sequence; identical to SEQ ID NO: 2011
  Synthetic

SEQ ID NO: 2018 - DNA, 1416 bp, Artificial Sequence; identical to SEQ ID NO: 1884
  Synthetic

SEQ ID NO: 2019 - protein, 449 aa, Artificial Sequence; identical to SEQ ID NO: 2011
  Synthetic

SEQ ID NO: 2020 - DNA, 1416 bp, Artificial Sequence; identical to SEQ ID NO: 1884
  Synthetic

SEQ ID NO: 2021 - protein, 449 aa, Artificial Sequence; identical to SEQ ID NO: 2011
  Synthetic

SEQ ID NO: 2022 - DNA, 1416 bp, Artificial Sequence; identical to SEQ ID NO: 1884
  Synthetic

SEQ ID NO: 2023 - protein, 449 aa, Artificial Sequence; identical to SEQ ID NO: 2011
  Synthetic

SEQ ID NO: 2024 - DNA, 1416 bp, Artificial Sequence; identical to SEQ ID NO: 1884
  Synthetic

SEQ ID NO: 2025 - protein, 449 aa, Artificial Sequence; identical to SEQ ID NO: 2011
  Synthetic

SEQ ID NO: 2026 - DNA, 1416 bp, Artificial Sequence; identical to SEQ ID NO: 1884
  Synthetic

SEQ ID NO: 2027 - protein, 449 aa, Artificial Sequence; identical to SEQ ID NO: 2011
  Synthetic

SEQ ID NO: 2028 - DNA, 1416 bp, Artificial Sequence; identical to SEQ ID NO: 1884
  Synthetic

SEQ ID NO: 2029 - protein, 449 aa, Artificial Sequence; identical to SEQ ID NO: 2011
  Synthetic

SEQ ID NO: 2030 - DNA, 1416 bp, Artificial Sequence; identical to SEQ ID NO: 1884
  Synthetic

SEQ ID NO: 2031 - protein, 449 aa, Artificial Sequence
  Synthetic
EVQLLESGGGLVQPGGSLRLSCAASGFTFNAYAMSWVRQAPGKGLEWVSTISGSGSTTYYADSVKGRFTISRDNSKNTLDLQMNSLRAEDTAVYYCAKVAGSNFFFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2032 - DNA, 1416 bp, Artificial Sequence; identical to SEQ ID NO: 1884
  Synthetic

SEQ ID NO: 2033 - protein, 449 aa, Artificial Sequence; identical to SEQ ID NO: 2031
  Synthetic

SEQ ID NO: 2034 - DNA, 1416 bp, Artificial Sequence; identical to SEQ ID NO: 1884
  Synthetic

SEQ ID NO: 2035 - protein, 449 aa, Artificial Sequence; identical to SEQ ID NO: 2031
  Synthetic

SEQ ID NO: 2036 - DNA, 1416 bp, Artificial Sequence; identical to SEQ ID NO: 1884
  Synthetic

SEQ ID NO: 2037 - protein, 449 aa, Artificial Sequence; identical to SEQ ID NO: 2031
  Synthetic

SEQ ID NO: 2038 - DNA, 1416 bp, Artificial Sequence; identical to SEQ ID NO: 1884
  Synthetic

SEQ ID NO: 2039 - protein, 449 aa, Artificial Sequence; identical to SEQ ID NO: 2031
  Synthetic

SEQ ID NO: 2040 - DNA, 1416 bp, Artificial Sequence; identical to SEQ ID NO: 1884
  Synthetic

SEQ ID NO: 2041 - protein, 449 aa, Artificial Sequence; identical to SEQ ID NO: 2031
  Synthetic

SEQ ID NO: 2042 - DNA, 1416 bp, Artificial Sequence; identical to SEQ ID NO: 1884
  Synthetic

SEQ ID NO: 2043 - protein, 449 aa, Artificial Sequence; identical to SEQ ID NO: 2031
  Synthetic

SEQ ID NO: 2044 - DNA, 1416 bp, Artificial Sequence; identical to SEQ ID NO: 1884
  Synthetic

SEQ ID NO: 2045 - protein, 449 aa, Artificial Sequence; identical to SEQ ID NO: 2031
  Synthetic

SEQ ID NO: 2046 - DNA, 1416 bp, Artificial Sequence; identical to SEQ ID NO: 1884
  Synthetic

SEQ ID NO: 2047 - protein, 449 aa, Artificial Sequence; identical to SEQ ID NO: 2031
  Synthetic

SEQ ID NO: 2048 - DNA, 1416 bp, Artificial Sequence; identical to SEQ ID NO: 1884
  Synthetic

SEQ ID NO: 2049 - protein, 449 aa, Artificial Sequence; identical to SEQ ID NO: 2031
  Synthetic

SEQ ID NO: 2050 - DNA, 1416 bp, Artificial Sequence; identical to SEQ ID NO: 1884
  Synthetic

SEQ ID NO: 2051 - protein, 449 aa, Artificial Sequence; identical to SEQ ID NO: 2031
  Synthetic

SEQ ID NO: 2052 - DNA, 1416 bp, Artificial Sequence; identical to SEQ ID NO: 1884
  Synthetic

SEQ ID NO: 2053 - protein, 449 aa, Artificial Sequence; identical to SEQ ID NO: 2031
  Synthetic

SEQ ID NO: 2054 - DNA, 1416 bp, Artificial Sequence; identical to SEQ ID NO: 1884
  Synthetic

SEQ ID NO: 2055 - protein, 449 aa, Artificial Sequence; identical to SEQ ID NO: 2031
  Synthetic

SEQ ID NO: 2056 - DNA, 1416 bp, Artificial Sequence; identical to SEQ ID NO: 1884
  Synthetic

SEQ ID NO: 2057 - protein, 449 aa, Artificial Sequence; identical to SEQ ID NO: 1891
  Synthetic

SEQ ID NO: 2058 - DNA, 1416 bp, Artificial Sequence; identical to SEQ ID NO: 1884
  Synthetic

SEQ ID NO: 2059 - protein, 449 aa, Artificial Sequence; identical to SEQ ID NO: 1891
  Synthetic

SEQ ID NO: 2060 - DNA, 1416 bp, Artificial Sequence; identical to SEQ ID NO: 1884
  Synthetic

SEQ ID NO: 2061 - protein, 449 aa, Artificial Sequence; identical to SEQ ID NO: 1891
  Synthetic

SEQ ID NO: 2062 - DNA, 1416 bp, Artificial Sequence; identical to SEQ ID NO: 1884
  Synthetic

SEQ ID NO: 2063 - protein, 449 aa, Artificial Sequence; identical to SEQ ID NO: 1891
  Synthetic

SEQ ID NO: 2064 - DNA, 1416 bp, Artificial Sequence; identical to SEQ ID NO: 1884
  Synthetic

SEQ ID NO: 2065 - protein, 449 aa, Artificial Sequence; identical to SEQ ID NO: 1891
  Synthetic

SEQ ID NO: 2066 - DNA, 1416 bp, Artificial Sequence; identical to SEQ ID NO: 1884
  Synthetic

SEQ ID NO: 2067 - protein, 449 aa, Artificial Sequence; identical to SEQ ID NO: 1891
  Synthetic

SEQ ID NO: 2068 - DNA, 1416 bp, Artificial Sequence; identical to SEQ ID NO: 1884
  Synthetic

SEQ ID NO: 2069 - protein, 449 aa, Artificial Sequence; identical to SEQ ID NO: 1891
  Synthetic

SEQ ID NO: 2070 - DNA, 1416 bp, Artificial Sequence; identical to SEQ ID NO: 1884
  Synthetic

SEQ ID NO: 2071 - protein, 449 aa, Artificial Sequence; identical to SEQ ID NO: 1891
  Synthetic

SEQ ID NO: 2072 - DNA, 1416 bp, Artificial Sequence; identical to SEQ ID NO: 1884
  Synthetic

SEQ ID NO: 2073 - protein, 449 aa, Artificial Sequence; identical to SEQ ID NO: 1891
  Synthetic

SEQ ID NO: 2074 - DNA, 1416 bp, Artificial Sequence; identical to SEQ ID NO: 1884
  Synthetic

SEQ ID NO: 2075 - protein, 449 aa, Artificial Sequence
  Synthetic
EVQLLESGGGLVQPGGSLRLSCAVSGFTFSRYAMSWVRQAPGKGLEWVSEMRGSSGSTYYADSVKGRFTISRDNSKNTLYLQMNSLRVEDTAIYYCAKEFSSNSLFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2076 - DNA, 1416 bp, Artificial Sequence; identical to SEQ ID NO: 1884
  Synthetic

SEQ ID NO: 2077 - protein, 449 aa, Artificial Sequence; identical to SEQ ID NO: 2075
  Synthetic

SEQ ID NO: 2078 - DNA, 1416 bp, Artificial Sequence; identical to SEQ ID NO: 1884
  Synthetic

SEQ ID NO: 2079 - protein, 449 aa, Artificial Sequence; identical to SEQ ID NO: 2075
  Synthetic

SEQ ID NO: 2080 - DNA, 1416 bp, Artificial Sequence; identical to SEQ ID NO: 1884
  Synthetic

SEQ ID NO: 2081 - protein, 449 aa, Artificial Sequence; identical to SEQ ID NO: 2075
  Synthetic

SEQ ID NO: 2082 - DNA, 1416 bp, Artificial Sequence; identical to SEQ ID NO: 1884
  Synthetic

SEQ ID NO: 2083 - protein, 449 aa, Artificial Sequence; identical to SEQ ID NO: 2075
  Synthetic

SEQ ID NO: 2084 - DNA, 1416 bp, Artificial Sequence; identical to SEQ ID NO: 1884
  Synthetic

SEQ ID NO: 2085 - protein, 449 aa, Artificial Sequence; identical to SEQ ID NO: 2075
  Synthetic

SEQ ID NO: 2086 - DNA, 1416 bp, Artificial Sequence; identical to SEQ ID NO: 1884
  Synthetic

SEQ ID NO: 2087 - protein, 449 aa, Artificial Sequence; identical to SEQ ID NO: 2075
  Synthetic

SEQ ID NO: 2088 - DNA, 1416 bp, Artificial Sequence; identical to SEQ ID NO: 1884
  Synthetic

SEQ ID NO: 2089 - protein, 449 aa, Artificial Sequence; identical to SEQ ID NO: 2075
  Synthetic

SEQ ID NO: 2090 - DNA, 1416 bp, Artificial Sequence; identical to SEQ ID NO: 1884
  Synthetic

SEQ ID NO: 2091 - protein, 449 aa, Artificial Sequence; identical to SEQ ID NO: 2075
  Synthetic

SEQ ID NO: 2092 - DNA, 1416 bp, Artificial Sequence; identical to SEQ ID NO: 1884
  Synthetic

SEQ ID NO: 2093 - protein, 449 aa, Artificial Sequence; identical to SEQ ID NO: 2075
  Synthetic

SEQ ID NO: 2094 - DNA, 1416 bp, Artificial Sequence; identical to SEQ ID NO: 1884
  Synthetic

SEQ ID NO: 2095 - protein, 449 aa, Artificial Sequence; identical to SEQ ID NO: 2075
  Synthetic

SEQ ID NO: 2096 - DNA, 1416 bp, Artificial Sequence; identical to SEQ ID NO: 1884
  Synthetic

SEQ ID NO: 2097 - protein, 449 aa, Artificial Sequence; identical to SEQ ID NO: 2075
  Synthetic

SEQ ID NO: 2098 - DNA, 1416 bp, Artificial Sequence; identical to SEQ ID NO: 1884
  Synthetic

SEQ ID NO: 2099 - protein, 449 aa, Artificial Sequence; identical to SEQ ID NO: 2075
  Synthetic

SEQ ID NO: 2100 - DNA, 1416 bp, Artificial Sequence; identical to SEQ ID NO: 1884
  Synthetic

SEQ ID NO: 2101 - protein, 446 aa, Artificial Sequence
  Synthetic
EVQLVESGGGLVQPGGSLRLSCAASGFTFSSNWMSWVRQAPGKGLDWVASMKQDGSEIYYVDSVKGRFTISRDNAKNSLHLQMNSLRAEDTAVYYCVRGGWRFESWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2102 - DNA, 1416 bp, Artificial Sequence; identical to SEQ ID NO: 1884
  Synthetic

SEQ ID NO: 2103 - protein, 446 aa, Artificial Sequence; identical to SEQ ID NO: 2101
  Synthetic

SEQ ID NO: 2104 - DNA, 1416 bp, Artificial Sequence; identical to SEQ ID NO: 1884
  Synthetic

SEQ ID NO: 2105 - protein, 446 aa, Artificial Sequence; identical to SEQ ID NO: 2101
  Synthetic

SEQ ID NO: 2106 - DNA, 1416 bp, Artificial Sequence; identical to SEQ ID NO: 1884
  Synthetic

SEQ ID NO: 2107 - protein, 446 aa, Artificial Sequence
  Synthetic
EVQLVESGGGLVQPGGSLRLSCAASGFTFSSNWMSWVRQAPGKGLDWVASIKQDGSEIYYVDSVKGRFTISRDNAKNSLHLQMNSLRAEDTAVYYCVRGGWRFESWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2108 - DNA, 1416 bp, Artificial Sequence; identical to SEQ ID NO: 1884
  Synthetic

SEQ ID NO: 2109 - protein, 446 aa, Artificial Sequence; identical to SEQ ID NO: 2101
  Synthetic

SEQ ID NO: 2110 - DNA, 1416 bp, Artificial Sequence; identical to SEQ ID NO: 1884
  Synthetic

SEQ ID NO: 2111 - protein, 446 aa, Artificial Sequence
  Synthetic
EVQLVESGGGLVQPGGSLRLSCAASGFTFSSNWMSWVRQAPGKGLDWVASMKQHGSEIYYVDSVKGRFTISRDNAKNSLHLQMNSLRAEDTAVYYCVRGGWRFESWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2112 - DNA, 1416 bp, Artificial Sequence; identical to SEQ ID NO: 1884
  Synthetic

SEQ ID NO: 2113 - protein, 446 aa, Artificial Sequence
  Synthetic
EVQLVESGGGLVQPGGSLRLSCAASGFTFSSNWMSWVRQAPGKGLDWVASMKQDASEIYYVDSVKGRFTISRDNAKNSLHLQMNSLRAEDTAVYYCVRGGWRFESWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2114 - DNA, 1416 bp, Artificial Sequence; identical to SEQ ID NO: 1884
  Synthetic

SEQ ID NO: 2115 - protein, 446 aa, Artificial Sequence
  Synthetic
EVQLVESGGGLVQPGGSLRLSCAASGFTFSSNWMSWVRQAPGKGLDWVASMKQDLSEIYYVDSVKGRFTISRDNAKNSLHLQMNSLRAEDTAVYYCVRGGWRFESWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2116 - DNA, 1416 bp, Artificial Sequence; identical to SEQ ID NO: 1884
  Synthetic

SEQ ID NO: 2117 - protein, 446 aa, Artificial Sequence
  Synthetic
EVQLVESGGGLVQPGGSLRLSCAASGFTFSSNWMSWVRQAPGKGLDWVASMKQDGSEIYYVESVKGRFTISRDNAKNSLHLQMNSLRAEDTAVYYCVRGGWRFESWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2118 - DNA, 1416 bp, Artificial Sequence; identical to SEQ ID NO: 1884
  Synthetic

SEQ ID NO: 2119 - protein, 446 aa, Artificial Sequence
  Synthetic
EVQLVESGGGLVQPGGSLRLSCAASGFTFSSNWMSWVRQAPGKGLDWVASIKQDASEIYYVDAVKGRFTISRDNAKNSLHLQMNSLRAEDTAVYYCVRGGWRFESWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2120 - DNA, 1416 bp, Artificial Sequence; identical to SEQ ID NO: 1884
  Synthetic

SEQ ID NO: 2121 - protein, 446 aa, Artificial Sequence; identical to SEQ ID NO: 2119
  Synthetic

SEQ ID NO: 2122 - DNA, 1416 bp, Artificial Sequence; identical to SEQ ID NO: 1884
  Synthetic

SEQ ID NO: 2123 - protein, 446 aa, Artificial Sequence; identical to SEQ ID NO: 2119
  Synthetic

SEQ ID NO: 2124 - DNA, 1416 bp, Artificial Sequence; identical to SEQ ID NO: 1884
  Synthetic

SEQ ID NO: 2125 - protein, 446 aa, Artificial Sequence; identical to SEQ ID NO: 2119
  Synthetic

SEQ ID NO: 2126 - DNA, 1416 bp, Artificial Sequence; identical to SEQ ID NO: 1884
  Synthetic

SEQ ID NO: 2127 - protein, 446 aa, Artificial Sequence
  Synthetic
EVQLVESGGGLVQPGGSLRLSCAASGFTFSSNWMSWVRQAPGKGLDWVASIKQDASEIYYVESVKGRFTISRDNAKNSLHLQMNSLRAEDTAVYYCVRGGWRFESWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2128 - DNA, 1416 bp, Artificial Sequence; identical to SEQ ID NO: 1884
  Synthetic

SEQ ID NO: 2129 - protein, 446 aa, Artificial Sequence; identical to SEQ ID NO: 2127
  Synthetic

SEQ ID NO: 2130 - DNA, 1416 bp, Artificial Sequence; identical to SEQ ID NO: 1884
  Synthetic

SEQ ID NO: 2131 - protein, 446 aa, Artificial Sequence; identical to SEQ ID NO: 2127
  Synthetic

SEQ ID NO: 2132 - DNA, 1416 bp, Artificial Sequence; identical to SEQ ID NO: 1884
  Synthetic

SEQ ID NO: 2133 - protein, 446 aa, Artificial Sequence; identical to SEQ ID NO: 2127
  Synthetic

SEQ ID NO: 2134 - DNA, 1416 bp, Artificial Sequence; identical to SEQ ID NO: 1884
  Synthetic

SEQ ID NO: 2135 - protein, 446 aa, Artificial Sequence
  Synthetic
EVQLVESGGGLVQPGGSLRLSCAASGFTFSSNWMSWVRQAPGKGLDWVASMKQDGSEIYYVDAVKGRFTISRDNAKNSLHLQMNSLRAEDTAVYYCVRGGWRFESWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2136 - DNA, 1416 bp, Artificial Sequence; identical to SEQ ID NO: 1884
  Synthetic

SEQ ID NO: 2137 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNQLQEKGIYDAMSEFDIFINYIEAYMTMKIRN

SEQ ID NO: 2138 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNQLQEKGIYDAMSEFDIFINYIEAYMTMKIRN

SEQ ID NO: 2139 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNQLQEKGIYKAMSEFDIFINYIEAYMTMKIRN

SEQ ID NO: 2140 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNQLQEKGIYKAMSEFDIFINYIEAYMTMKIRN

SEQ ID NO: 2141 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMNIRN

SEQ ID NO: 2142 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMNIRN

SEQ ID NO: 2143 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYVTMKIRN

SEQ ID NO: 2144 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYVTMKIRN

SEQ ID NO: 2145 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRD

SEQ ID NO: 2146 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRD

SEQ ID NO: 2147 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENAGGSGGKSKAVEQVKNAFNKLQEKGIYDAMSEFDIFINYIEAYMTMKIRN

SEQ ID NO: 2148 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENAGGSGGKSKAVEQVKNAFNKLQEKGIYDAMSEFDIFINYIEAYMTMKIRN

SEQ ID NO: 2149 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENVGGSGGKSKAVEQVKNAFNKLQEKGIYDAMSEFDIFINYIEAYMTMKIRN

SEQ ID NO: 2150 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENVGGSGGKSKAVEQVKNAFNKLQEKGIYDAMSEFDIFINYIEAYMTMKIRN

SEQ ID NO: 2151 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSAGKSKAVEQVKNAFNKLQEKGIYDAMSEFDIFINYIEAYMTMKIRN

SEQ ID NO: 2152 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSAGKSKAVEQVKNAFNKLQEKGIYDAMSEFDIFINYIEAYMTMKIRN

SEQ ID NO: 2153 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMNIRN

SEQ ID NO: 2154 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMNIRN

SEQ ID NO: 2155 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYVTMKIRN

SEQ ID NO: 2156 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYVTMKIRN

SEQ ID NO: 2157 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRD

SEQ ID NO: 2158 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRD

SEQ ID NO: 2159 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENAGGSGGKSKAVEQVKNAFNKLQEKGIYKAMSEFDIFINYIEAYMTMKIRN

SEQ ID NO: 2160 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENAGGSGGKSKAVEQVKNAFNKLQEKGIYKAMSEFDIFINYIEAYMTMKIRN

SEQ ID NO: 2161 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENVGGSGGKSKAVEQVKNAFNKLQEKGIYKAMSEFDIFINYIEAYMTMKIRN

SEQ ID NO: 2162 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENVGGSGGKSKAVEQVKNAFNKLQEKGIYKAMSEFDIFINYIEAYMTMKIRN

SEQ ID NO: 2163 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSAGKSKAVEQVKNAFNKLQEKGIYKAMSEFDIFINYIEAYMTMKIRN

SEQ ID NO: 2164 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSAGKSKAVEQVKNAFNKLQEKGIYKAMSEFDIFINYIEAYMTMKIRN

SEQ ID NO: 2165 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKPHVNSLGENLKTLRLRLRRCHRFLPCENGGGSGGKSKAVEQVKNAFNKLQEKGIYKAMSEFDIFINYIEAYMTMKIRN

SEQ ID NO: 2166 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKPHVNSLGENLKTLRLRLRRCHRFLPCENGGGSGGKSKAVEQVKNAFNKLQEKGIYKAMSEFDIFINYIEAYMTMKIRN

SEQ ID NO: 2167 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKPHVNSLGENLKTLRLRLRRCHRFLPCENGGGSGGKSKAVEQVKNAFNKLQEKGIYDAMSEFDIFINYIEAYMTMKIRN

SEQ ID NO: 2168 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKPHVNSLGENLKTLRLRLRRCHRFLPCENGGGSGGKSKAVEQVKNAFNKLQEKGIYDAMSEFDIFINYIEAYMTMKIRN

SEQ ID NO: 2169 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCKNGGGSGGKSKAVEQVKNAFNKLQEKGIYKAMSEFDIFINYIEAYMTMKIRN

SEQ ID NO: 2170 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCKNGGGSGGKSKAVEQVKNAFNKLQEKGIYKAMSEFDIFINYIEAYMTMKIRN

SEQ ID NO: 2171 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCKNGGGSGGKSKAVEQVKNAFNKLQEKGIYDAMSEFDIFINYIEAYMTMKIRN

SEQ ID NO: 2172 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCKNGGGSGGKSKAVEQVKNAFNKLQEKGIYDAMSEFDIFINYIEAYMTMKIRN

SEQ ID NO: 2173 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDYKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2174 - protein, 166 aa, Artificial Sequence
  Synthetic
SPGQGTQSENSCTHFPGNLPNMLRDLRDAFSRVKTFFQMKDQLDNLLLKESLLEDYKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2175 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDYKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2176 - protein, 166 aa, Artificial Sequence
  Synthetic
SPGQGTQSENSCTHFPGNLPNMLRDLRDAFSRVKTFFQMKDQLDNLLLKESLLEDYKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2177 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCDRFLPCENGGGSGGKSKAVEQVKNAFNKLQEKGIYKAMSEFDIFINYIEAYMTMKIRN

SEQ ID NO: 2178 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCDRFLPCENGGGSGGKSKAVEQVKNAFNKLQEKGIYKAMSEFDIFINYIEAYMTMKIRN

SEQ ID NO: 2179 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCDRFLPCENGGGSGGKSKAVEQVKNAFNKLQEKGIYDAMSEFDIFINYIEAYMTMKIRN

SEQ ID NO: 2180 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCDRFLPCENGGGSGGKSKAVEQVKNAFNKLQEKGIYDAMSEFDIFINYIEAYMTMKIRN

SEQ ID NO: 2181 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTQFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2182 - protein, 166 aa, Artificial Sequence
  Synthetic
SPGQGTQSENSCTQFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2183 - DNA, 639 bp, Artificial Sequence
  Synthetic
tcctatgagctgactcagtcaccctcagtgtccgtgtccccaggacagacagccagcatcacctgctctggagatcaattggggtataaatatgcttgctggtatcagcagaagccaggccagtcccctgtgctggtcatctatcaagatagcaggcgaccctcagggatccctgagcgattctctggctccaactctgggaacacagccactctgaccatcagcgggacccaggctatggatgaggctgtctatttctgtcaggcgtgggacagcaccactgtggtattcggcggagggaccaaactgaccgtcctaagtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 2184 - DNA, 1356 bp, Artificial Sequence
  Synthetic
caggtgcagctgcaggcgtcgggcccaggactgatgaagccttcacagaccctgtccctcacctgcactgtctctggtggctccatcagcagtggtgtttactactggagctggatccgccagaacccagggaagggcctggagtggattggatacatctattacagtgggaccacttactacaatccgtccctcaagagtcgagttaccatctcaatcgacacgtctaagaaccagttctccctgaagctgagctctgtgactgccgcggacacggccgtgtattactgtgcgaggggagtgaccacggtggtccctgatgcttttgatatctggggccaagggacaatggtcaccgtgtcttcagcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgtgcgaggagcagtacggcagcacgtaccgttgcgtcagcgtcctcaccgtcctgcaccaggactggctgaatggcaaggagtacaagtgcaaggtgtccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggctag

SEQ ID NO: 2185 - protein, 212 aa, Artificial Sequence
  Synthetic
SYELTQSPSVSVSPGQTASITCSGDQLGYKYACWYQQKPGQSPVLVIYQDSRRPSGIPERFSGSNSGNTATLTISGTQAMDEAVYFCQAWDSTTVVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2186 - protein, 451 aa, Artificial Sequence
  Synthetic
QVQLQASGPGLMKPSQTLSLTCTVSGGSISSGVYYWSWIRQNPGKGLEWIGYIYYSGTTYYNPSLKSRVTISIDTSKNQFSLKLSSVTAADTAVYYCARGVTTVVPDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2187-2189 - skipped (3 entries)

SEQ ID NO: 2190 - protein, 11 aa, Artificial Sequence
  Synthetic
SGDQLGYKYAS

SEQ ID NO: 2191 - protein, 7 aa, Artificial Sequence
  Synthetic
QDSRRPS

SEQ ID NO: 2192 - protein, 9 aa, Artificial Sequence
  Synthetic
QAWDSTTVV

SEQ ID NO: 2193-2195 - skipped (3 entries)

SEQ ID NO: 2196 - protein, 7 aa, Artificial Sequence
  Synthetic
SGVYYWS

SEQ ID NO: 2197 - protein, 16 aa, Artificial Sequence
  Synthetic
YIYYSGTTYYNPSLKS

SEQ ID NO: 2198 - protein, 12 aa, Artificial Sequence
  Synthetic
GVTTVVPDAFDI

SEQ ID NO: 2199 - protein, 11 aa, Artificial Sequence
  Synthetic
  MISC_FEATURE (1)..(1): Xaa is R or Q
  MISC_FEATURE (6)..(6): Xaa is V or I
  MISC_FEATURE (7)..(7): Xaa is N or S
  MISC_FEATURE (8)..(8): Xaa is S, H, I, V or A
XASQSXXXNLA

SEQ ID NO: 2200 - protein, 7 aa, Artificial Sequence
  Synthetic
  MISC_FEATURE (3)..(3): Xaa is S or Y
  MISC_FEATURE (4)..(4): Xaa is T or I
GAXXRAT

SEQ ID NO: 2201 - protein, 10 aa, Artificial Sequence
  Synthetic
  MISC_FEATURE (2)..(2): Xaa is Q, H, or E
  MISC_FEATURE (3)..(3): Xaa is F or Y
  MISC_FEATURE (4)..(4): Xaa is K, Y, or I
  MISC_FEATURE (5)..(5): Xaa is N, T, L, I, or M
  MISC_FEATURE (6)..(6): Xaa is W, F, H or Y
  MISC_FEATURE (7)..(7): Xaa is absent or P
  MISC_FEATURE (9)..(9): Xaa isW, N, Y, H or L
QXXXXXXPXT

SEQ ID NO: 2202 - protein, 5 aa, Artificial Sequence
  Synthetic
  MISC_FEATURE (1)..(1): Xaa is A, R, T or S
  MISC_FEATURE (2)..(2): Xaa is Y or N
  MISC_FEATURE (3)..(3): Xaa is A or W
  MISC_FEATURE (5)..(5): Xaa is S or N
XXXMX

SEQ ID NO: 2203 - protein, 12 aa, Artificial Sequence
  Synthetic
  MISC_FEATURE (1)..(1): Xaa is V, E, A, or G
  MISC_FEATURE (2)..(2): Xaa is A, F, Y or G
  MISC_FEATURE (3)..(3): Xaa is G, S, Y, or W
  MISC_FEATURE (4)..(4): Xaa is S or R
  MISC_FEATURE (5)..(5): Xaa is absent or N
  MISC_FEATURE (6)..(6): Xaa is F, S, Y, or Absent
  MISC_FEATURE (7)..(7): Xaa is L or F or absent
  MISC_FEATURE (9)..(9): Xaa is D or E
  MISC_FEATURE (12)..(12): Xaa is Y, H, or S
XXXXXXXFXYYX

SEQ ID NO: 2204 - protein, 11 aa, Artificial Sequence
  Synthetic
  MISC_FEATURE (4)..(4): Xaa is R or Q
  MISC_FEATURE (7)..(7): Xaa is R, S, N, or F
  MISC_FEATURE (8)..(8): Xaa is K or N
  MISC_FEATURE (9)..(9): Xaa is H, Y, or D
QASXDIXXXLN

SEQ ID NO: 2205 - protein, 17 aa, Artificial Sequence
  Synthetic
  MISC_FEATURE (1)..(1): Xaa is T, E, or S
  MISC_FEATURE (2)..(2): Xaa is absent or M, V or I
  MISC_FEATURE (3)..(3): Xaa is S, R, or  K
  MISC_FEATURE (4)..(4): Xaa is G or Q
  MISC_FEATURE (5)..(5): Xaa is S, D or H
  MISC_FEATURE (6)..(6): Xaa is G, S, L, or A
  MISC_FEATURE (7)..(7): Xaa is S, G, or R
  MISC_FEATURE (8)..(8): Xaa is T, S, P, or E
  MISC_FEATURE (9)..(9): Xaa is T or I
  MISC_FEATURE (12)..(12): Xaa is A or V
  MISC_FEATURE (13)..(13): Xaa is D or E
  MISC_FEATURE (14)..(14): Xaa is S or A
XXXXXXXXXYYXXXVKG

SEQ ID NO: 2206 - protein, 7 aa, Artificial Sequence
  Synthetic
  MISC_FEATURE (1)..(1): Xaa is D, G, or H
  MISC_FEATURE (2)..(2): Xaa is A, V or T
  MISC_FEATURE (3)..(3): Xaa is S, A, or Y
  MISC_FEATURE (4)..(4): Xaa is T or N
XXXXLET

SEQ ID NO: 2207 - protein, 9 aa, Artificial Sequence
  Synthetic
  MISC_FEATURE (2)..(2): Xaa is Q or H
  MISC_FEATURE (4)..(4): Xaa is D, A, or G
  MISC_FEATURE (5)..(5): Xaa is N or K
  MISC_FEATURE (6)..(6): Xaa is L or I
  MISC_FEATURE (8)..(8): Xaa is I or L
QXYXXXPXT

SEQ ID NO: 2208 - protein, 5 aa, Artificial Sequence
  Synthetic
  MISC_FEATURE (1)..(1): Xaa is R or S
XYDIN

SEQ ID NO: 2209 - protein, 17 aa, Artificial Sequence
  Synthetic
  MISC_FEATURE (1)..(1): Xaa is W or R
  MISC_FEATURE (2)..(2): Xaa is M or L
  MISC_FEATURE (5)..(5): Xaa is N, Q, or K
  MISC_FEATURE (6)..(6): Xaa is S, A, or R
  MISC_FEATURE (8)..(8): Xaa is N or Q
  MISC_FEATURE (9)..(9): Xaa is S, A, or T
  MISC_FEATURE (11)..(11): Xaa is S, Q, or Y
  MISC_FEATURE (12)..(12): Xaa is V or T
  MISC_FEATURE (13)..(13): Xaa is Q or K
  MISC_FEATURE (14)..(14): Xaa is K or N
  MISC_FEATURE (16)..(16): Xaa is R or Q
  MISC_FEATURE (17)..(17): Xaa is G or I
XXNPXXGXXGXXXXFXX

SEQ ID NO: 2210 - protein, 15 aa, Artificial Sequence
  Synthetic
  MISC_FEATURE (1)..(1): Xaa is G, L or R
  MISC_FEATURE (2)..(2): Xaa is G, I or R
  MISC_FEATURE (3)..(3): Xaa is Y, R, I, G, or A
  MISC_FEATURE (4)..(4): Xaa is T, S, Y, or V
  MISC_FEATURE (5)..(5): Xaa is S or Y
  MISC_FEATURE (6)..(6): Xaa is S, A, I, or R
  MISC_FEATURE (7)..(7): Xaa is W, A, or S
  MISC_FEATURE (8)..(8): Xaa is absent or S
  MISC_FEATURE (9)..(9): Xaa is absent or F, W, or Y
  MISC_FEATURE (10)..(10): Xaa is absent or R, S, H, K or E
  MISC_FEATURE (11)..(11): Xaa is W, H, Y, or F
  MISC_FEATURE (12)..(12): Xaa is Y, V, A, or S
  MISC_FEATURE (14)..(14): Xaa is D or Q
  MISC_FEATURE (15)..(15): Xaa is L, Y, I, or H
XXXXXXXXXXXXFXX

SEQ ID NO: 2211 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2212 - protein, 11 aa, Artificial Sequence
  Synthetic
RASQSVNSNLA

SEQ ID NO: 2213 - protein, 11 aa, Artificial Sequence
  Synthetic
QASQDIRKHLN

SEQ ID NO: 2214 - protein, 11 aa, Artificial Sequence
  Synthetic
RASQDISSNLN

SEQ ID NO: 2215 - protein, 9 aa, Artificial Sequence
  Synthetic
QASQDIHLN

SEQ ID NO: 2216 - protein, 11 aa, Artificial Sequence
  Synthetic
RASQGIRKWLA

SEQ ID NO: 2217 - protein, 11 aa, Artificial Sequence
  Synthetic
RASQSVNSNLA

SEQ ID NO: 2218 - protein, 10 aa, Artificial Sequence
  Synthetic
SGDKLGERVS

SEQ ID NO: 2219 - protein, 7 aa, Artificial Sequence
  Synthetic
GASTRAT

SEQ ID NO: 2220 - protein, 7 aa, Artificial Sequence
  Synthetic
DASNLET

SEQ ID NO: 2221 - protein, 7 aa, Artificial Sequence
  Synthetic
AASRLQS

SEQ ID NO: 2222 - protein, 9 aa, Artificial Sequence
  Synthetic
QQFKNWPPT

SEQ ID NO: 2223 - protein, 9 aa, Artificial Sequence
  Synthetic
QHYDNLPIT

SEQ ID NO: 2224 - protein, 9 aa, Artificial Sequence
  Synthetic
LQAHGFPWT

SEQ ID NO: 2225 - protein, 9 aa, Artificial Sequence
  Synthetic
QQYDNLPLT

SEQ ID NO: 2226 - protein, 7 aa, Artificial Sequence
  Synthetic
QFWPPWT

SEQ ID NO: 2227 - protein, 5 aa, Artificial Sequence
  Synthetic
AYAMS

SEQ ID NO: 2228 - protein, 5 aa, Artificial Sequence
  Synthetic
RYDIN

SEQ ID NO: 2229 - protein, 5 aa, Artificial Sequence
  Synthetic
SYWMS

SEQ ID NO: 2230 - protein, 16 aa, Artificial Sequence
  Synthetic
TSGSGSTTYYADSVKG

SEQ ID NO: 2231 - protein, 16 aa, Artificial Sequence
  Synthetic
WMNPNSGNSSVQKFRG

SEQ ID NO: 2232 - protein, 17 aa, Artificial Sequence
  Synthetic
NIKQDGSEEYYVDSVKG

SEQ ID NO: 2233 - protein, 215 aa, Artificial Sequence
  Synthetic
EIVMTQSPATLSVSPGERATLSCRASQSINANLAWYQQKPGQAPRLLIYGAYTRATGIPDRFSGSGSGTEFTLTISSLQSEDFAVYYCQEFIMWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2234 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacgctaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattatgtggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2235 - protein, 215 aa, Artificial Sequence
  Synthetic
EIVMTQSPATLSVSPGERATLSCRASQSININLAWYQQKPGQAPRLLIYGAYTRATGIPDRFSGSGSGTEFTLTISSLQSEDFAVYYCQEFIMWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2236 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacattaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattatgtggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2237 - protein, 215 aa, Artificial Sequence
  Synthetic
EIVMTQSPATLSVSPGERATLSCRASQSINHNLAWYQQKPGQAPRLLIYGAYTRATGIPDRFSGSGSGTEFTLTISSLQSEDFAVYYCQEFIMWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2238 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaaccataacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattatgtggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2239 - protein, 215 aa, Artificial Sequence
  Synthetic
EIVMTQSPATLSVSPGERATLSCRASQSINVNLAWYQQKPGQAPRLLIYGAYTRATGIPDRFSGSGSGTEFTLTISSLQSEDFAVYYCQEFIMWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2240 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacgttaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattatgtggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2241 - protein, 215 aa, Artificial Sequence
  Synthetic
EIVMTQSPATLSVSPGERATLSCRASQSINSNLAWYQQKPGQAPRLLIYGAYTRATGIPDRFSGSGSGTEFTLTISSLQSEDFAVYYCQEFIIWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2242 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacagcaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattatttggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2243 - protein, 215 aa, Artificial Sequence
  Synthetic
EIVMTQSPATLSVSPGERATLSCRASQSINSNLAWYQQKPGQAPRLLIYGAYTRATGIPDRFSGSGSGTEFTLTISSLQSEDFAVYYCQEFILWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2244 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacagcaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2245 - protein, 215 aa, Artificial Sequence
  Synthetic
EIVMTQSPATLSVSPGERATLSCRASQSINSNLAWYQQKPGQAPRLLIYGAYTRATGIPDRFSGSGSGTEFTLTISSLQSEDFAVYYCQEFIMFPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2246 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacagcaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattatgtttcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2247 - protein, 215 aa, Artificial Sequence
  Synthetic
EIVMTQSPATLSVSPGERATLSCRASQSINSNLAWYQQKPGQAPRLLIYGAYTRATGIPDRFSGSGSGTEFTLTISSLQSEDFAVYYCQEFIMWPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2248 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacagcaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattatgtggcctccgtatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2249 - protein, 215 aa, Artificial Sequence
  Synthetic
EIVMTQSPATLSVSPGERATLSCRASQSINSNLAWYQQKPGQAPRLLIYGAYTRATGIPDRFSGSGSGTEFTLTISSLQSEDFAVYYCQEFIMWPPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2250 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacagcaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattatgtggcctccgcatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2251 - protein, 215 aa, Artificial Sequence
  Synthetic
EIVMTQSPATLSVSPGERATLSCRASQSINSNLAWYQQKPGQAPRLLIYGAYTRATGIPDRFSGSGSGTEFTLTISSLQSEDFAVYYCQEFIMWPPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2252 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacagcaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattatgtggcctccgaatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2253 - protein, 215 aa, Artificial Sequence
  Synthetic
EIVMTQSPATLSVSPGERATLSCRASQSINSNLAWYQQKPGQAPRLLIYGAYTRATGIPDRFSGSGSGTEFTLTISSLQSEDFAVYYCQEFIMWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2254 - DNA, 714 bp, Artificial Sequence; identical to SEQ ID NO: 304
  Synthetic

SEQ ID NO: 2255 - protein, 215 aa, Artificial Sequence
  Synthetic
EIVMTQSPATLSVSPGERATLSCRASQSINANLAWYQQKPGQAPRLLIYGAYTRATGIPDRFSGSGSGTEFTLTISSLQSEDFAVYYCQEFILWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2256 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacgctaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2257 - protein, 215 aa, Artificial Sequence
  Synthetic
EIVMTQSPATLSVSPGERATLSCRASQSINANLAWYQQKPGQAPRLLIYGAYTRATGIPDRFSGSGSGTEFTLTISSLQSEDFAVYYCQEFILWPPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2258 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacgctaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttggcctccgcatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2259 - protein, 215 aa, Artificial Sequence
  Synthetic
EIVMTQSPATLSVSPGERATLSCRASQSINANLAWYQQKPGQAPRLLIYGAYTRATGIPDRFSGSGSGTEFTLTISSLQSEDFAVYYCQEFILWPPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2260 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacgctaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttggcctccgaatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2261 - protein, 215 aa, Artificial Sequence
  Synthetic
EIVMTQSPATLSVSPGERATLSCRASQSINANLAWYQQKPGQAPRLLIYGAYTRATGIPDRFSGSGSGTEFTLTISSLQSEDFAVYYCQEFILFPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2262 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacgctaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttttcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2263 - protein, 215 aa, Artificial Sequence
  Synthetic
EIVMTQSPATLSVSPGERATLSCRASQSINANLAWYQQKPGQAPRLLIYGAYTRATGIPDRFSGSGSGTEFTLTISSLQSEDFAVYYCQEFILFPPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2264 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacgctaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttttcctccgaatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2265 - protein, 215 aa, Artificial Sequence
  Synthetic
EIVMTQSPATLSVSPGERATLSCRASQSINANLAWYQQKPGQAPRLLIYGAYTRATGIPDRFSGSGSGTEFTLTISSLQSEDFAVYYCQEFILFPPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2266 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaacgctaacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttttcctccgcatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2267 - protein, 215 aa, Artificial Sequence
  Synthetic
EIVMTQSPATLSVSPGERATLSCRASQSINHNLAWYQQKPGQAPRLLIYGAYTRATGIPDRFSGSGSGTEFTLTISSLQSEDFAVYYCQEFILWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2268 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaaccataacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2269 - protein, 215 aa, Artificial Sequence
  Synthetic
EIVMTQSPATLSVSPGERATLSCRASQSINHNLAWYQQKPGQAPRLLIYGAYTRATGIPDRFSGSGSGTEFTLTISSLQSEDFAVYYCQEFILWPPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2270 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaaccataacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttggcctccgaatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2271 - protein, 215 aa, Artificial Sequence
  Synthetic
EIVMTQSPATLSVSPGERATLSCRASQSINHNLAWYQQKPGQAPRLLIYGAYTRATGIPDRFSGSGSGTEFTLTISSLQSEDFAVYYCQEFILWPPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2272 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaaccataacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttggcctccgcatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2273 - protein, 215 aa, Artificial Sequence
  Synthetic
EIVMTQSPATLSVSPGERATLSCRASQSINHNLAWYQQKPGQAPRLLIYGAYTRATGIPDRFSGSGSGTEFTLTISSLQSEDFAVYYCQEFILFPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2274 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaaccataacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttttcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2275 - protein, 215 aa, Artificial Sequence
  Synthetic
EIVMTQSPATLSVSPGERATLSCRASQSINHNLAWYQQKPGQAPRLLIYGAYTRATGIPDRFSGSGSGTEFTLTISSLQSEDFAVYYCQEFILFPPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2276 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaaccataacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttttcctccgaatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2277 - protein, 215 aa, Artificial Sequence
  Synthetic
EIVMTQSPATLSVSPGERATLSCRASQSINHNLAWYQQKPGQAPRLLIYGAYTRATGIPDRFSGSGSGTEFTLTISSLQSEDFAVYYCQEFILFPPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2278 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtattaaccataacttagcctggtaccagcagaaacctggccaggctcccaggctcctcatctatggtgcatataccagggccactggtatcccagacaggttcagtggcagtgggtctgggacagagttcactctcaccatcagcagcctgcagtctgaagattttgcagtttattactgtcaggagtttattctttttcctccgcatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2279 - protein, 215 aa, Artificial Sequence
  Synthetic
EIVMTQSPATLSVSPGERATLSCRASQSVNSNLAWYQQKPGQAPRLLIYGASTRATGIPARFSGSGSGTEFTLTISSLQSEDFAVYYCQQFYNWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2280 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacagcaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2281 - protein, 215 aa, Artificial Sequence
  Synthetic
EIVMTQSPATLSVSPGERATLSCRASQSVNANLAWYQQKPGQAPRLLIYGASTRATGIPARFSGSGSGTEFTLTISSLQSEDFAVYYCQQFYNWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2282 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacgctaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2283 - protein, 215 aa, Artificial Sequence
  Synthetic
EIVMTQSPATLSVSPGERATLSCRASQSVNINLAWYQQKPGQAPRLLIYGASTRATGIPARFSGSGSGTEFTLTISSLQSEDFAVYYCQQFYNWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2284 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacattaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2285 - protein, 215 aa, Artificial Sequence
  Synthetic
EIVMTQSPATLSVSPGERATLSCRASQSVNHNLAWYQQKPGQAPRLLIYGASTRATGIPARFSGSGSGTEFTLTISSLQSEDFAVYYCQQFYNWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2286 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaaccataacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2287 - protein, 215 aa, Artificial Sequence
  Synthetic
EIVMTQSPATLSVSPGERATLSCRASQSVNVNLAWYQQKPGQAPRLLIYGASTRATGIPARFSGSGSGTEFTLTISSLQSEDFAVYYCQQFYNWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2288 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacgttaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2289 - protein, 215 aa, Artificial Sequence
  Synthetic
EIVMTQSPATLSVSPGERATLSCRASQSVNSNLAWYQQKPGQAPRLLIYGASTRATGIPARFSGSGSGTEFTLTISSLQSEDFAVYYCQQFYNFPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2290 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacagcaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactttcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2291 - protein, 215 aa, Artificial Sequence
  Synthetic
EIVMTQSPATLSVSPGERATLSCRASQSVNSNLAWYQQKPGQAPRLLIYGASTRATGIPARFSGSGSGTEFTLTISSLQSEDFAVYYCQQFYNWPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2292 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacagcaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgtatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2293 - protein, 215 aa, Artificial Sequence
  Synthetic
EIVMTQSPATLSVSPGERATLSCRASQSVNSNLAWYQQKPGQAPRLLIYGASTRATGIPARFSGSGSGTEFTLTISSLQSEDFAVYYCQQFYNWPPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2294 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacagcaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgcatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2295 - protein, 215 aa, Artificial Sequence
  Synthetic
EIVMTQSPATLSVSPGERATLSCRASQSVNSNLAWYQQKPGQAPRLLIYGASTRATGIPARFSGSGSGTEFTLTISSLQSEDFAVYYCQQFYNWPPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2296 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacagcaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgaatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2297 - protein, 215 aa, Artificial Sequence; identical to SEQ ID NO: 2279
  Synthetic

SEQ ID NO: 2298 - DNA, 714 bp, Artificial Sequence; identical to SEQ ID NO: 2280
  Synthetic

SEQ ID NO: 2299 - protein, 215 aa, Artificial Sequence; identical to SEQ ID NO: 2281
  Synthetic

SEQ ID NO: 2300 - DNA, 714 bp, Artificial Sequence; identical to SEQ ID NO: 2282
  Synthetic

SEQ ID NO: 2301 - protein, 215 aa, Artificial Sequence
  Synthetic
EIVMTQSPATLSVSPGERATLSCRASQSVNANLAWYQQKPGQAPRLLIYGASTRATGIPARFSGSGSGTEFTLTISSLQSEDFAVYYCQQFYNFPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2302 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacgctaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactttcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2303 - protein, 215 aa, Artificial Sequence
  Synthetic
EIVMTQSPATLSVSPGERATLSCRASQSVNANLAWYQQKPGQAPRLLIYGASTRATGIPARFSGSGSGTEFTLTISSLQSEDFAVYYCQQFYNWPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2304 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacgctaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgtatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2305 - protein, 215 aa, Artificial Sequence
  Synthetic
EIVMTQSPATLSVSPGERATLSCRASQSVNANLAWYQQKPGQAPRLLIYGASTRATGIPARFSGSGSGTEFTLTISSLQSEDFAVYYCQQFYNWPPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2306 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacgctaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgcatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2307 - protein, 215 aa, Artificial Sequence
  Synthetic
EIVMTQSPATLSVSPGERATLSCRASQSVNANLAWYQQKPGQAPRLLIYGASTRATGIPARFSGSGSGTEFTLTISSLQSEDFAVYYCQQFYNFPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2308 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacgctaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactttcctccgtatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2309 - protein, 215 aa, Artificial Sequence
  Synthetic
EIVMTQSPATLSVSPGERATLSCRASQSVNANLAWYQQKPGQAPRLLIYGASTRATGIPARFSGSGSGTEFTLTISSLQSEDFAVYYCQQFYNFPPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2310 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaacgctaacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactttcctccgcatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2311 - protein, 215 aa, Artificial Sequence; identical to SEQ ID NO: 2285
  Synthetic

SEQ ID NO: 2312 - DNA, 714 bp, Artificial Sequence; identical to SEQ ID NO: 2286
  Synthetic

SEQ ID NO: 2313 - protein, 215 aa, Artificial Sequence
  Synthetic
EIVMTQSPATLSVSPGERATLSCRASQSVNHNLAWYQQKPGQAPRLLIYGASTRATGIPARFSGSGSGTEFTLTISSLQSEDFAVYYCQQFYNFPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2314 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaaccataacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactttcctccgtggacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2315 - protein, 215 aa, Artificial Sequence
  Synthetic
EIVMTQSPATLSVSPGERATLSCRASQSVNHNLAWYQQKPGQAPRLLIYGASTRATGIPARFSGSGSGTEFTLTISSLQSEDFAVYYCQQFYNWPPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2316 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaaccataacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgaatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2317 - protein, 215 aa, Artificial Sequence
  Synthetic
EIVMTQSPATLSVSPGERATLSCRASQSVNHNLAWYQQKPGQAPRLLIYGASTRATGIPARFSGSGSGTEFTLTISSLQSEDFAVYYCQQFYNWPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2318 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaaccataacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactggcctccgtatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2319 - protein, 215 aa, Artificial Sequence
  Synthetic
EIVMTQSPATLSVSPGERATLSCRASQSVNHNLAWYQQKPGQAPRLLIYGASTRATGIPARFSGSGSGTEFTLTISSLQSEDFAVYYCQQFYNFPPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2320 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaaccataacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactttcctccgaatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2321 - protein, 215 aa, Artificial Sequence
  Synthetic
EIVMTQSPATLSVSPGERATLSCRASQSVNHNLAWYQQKPGQAPRLLIYGASTRATGIPARFSGSGSGTEFTLTISSLQSEDFAVYYCQQFYNFPPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2322 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttaaccataacttagcctggtaccagcagaaacctggccaagctcccaggctcctcatctatggtgcatccaccagggccactggtatcccagccaggttcagtggcagtgggtctgggacagagttcactctcaccatcagcagcctgcagtctgaagattttgcagtttattactgtcagcagttttataactttcctccgtatacgttcggccaggggaccaaggtggaaatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2323 - protein, 214 aa, Artificial Sequence
  Synthetic
EIVMTQSPATLSVSPGERATLSCRASQSVSSNLAWYQQKSGQAPRLLIYGASIRATGIPARFSGSGSGTEFTFTISSLQSEDFAVYYCQQYKNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2324 - DNA, 711 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttagcagcaacttagcctggtatcagcagaaatctggccaggctcccaggctcctcatctatggtgcatccatcagggccactggtatcccagccaggtttagcggcagtgggtctgggacagagttcaccttcactatcagcagcctgcagtctgaagattttgcagtctattactgtcagcagtataagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2325 - protein, 214 aa, Artificial Sequence
  Synthetic
EIVMTQSPATLSVSPGERATLSCRASQSVSSNLAWYQQKPGQAPRLLIYGASIRATGIPARFSGSGSGTEFTFTISSLQSEDFAVYYCQQYKNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2326 - DNA, 711 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttagcagcaacttagcctggtatcagcagaaacctggccaggctcccaggctcctcatctatggtgcatccatcagggccactggtatcccagccaggtttagcggcagtgggtctgggacagagttcaccttcactatcagcagcctgcagtctgaagattttgcagtctattactgtcagcagtataagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2327 - protein, 214 aa, Artificial Sequence
  Synthetic
EIVMTQSPATLSVSPGERATLSCRASQSVSSNLAWYQQKSGQAPRLLIYGASIRATGIPARFSGSGSGTEFTLTISSLQSEDFAVYYCQQYKNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2328 - DNA, 711 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttagcagcaacttagcctggtatcagcagaaatctggccaggctcccaggctcctcatctatggtgcatccatcagggccactggtatcccagccaggtttagcggcagtgggtctgggacagagttcacccttactatcagcagcctgcagtctgaagattttgcagtctattactgtcagcagtataagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2329 - protein, 214 aa, Artificial Sequence; identical to SEQ ID NO: 2323
  Synthetic

SEQ ID NO: 2330 - DNA, 711 bp, Artificial Sequence; identical to SEQ ID NO: 2324
  Synthetic

SEQ ID NO: 2331 - protein, 214 aa, Artificial Sequence
  Synthetic
EIVMTQSPATLSVSPGERATLSCRASQSVSSNLAWYQQKSGQAPRLLIYGASIRATGIPARFSGSGSGTEFTFTISSLQSEDFAVYYCQQYKNFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2332 - DNA, 711 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttagcagcaacttagcctggtatcagcagaaatctggccaggctcccaggctcctcatctatggtgcatccatcagggccactggtatcccagccaggtttagcggcagtgggtctgggacagagttcaccttcactatcagcagcctgcagtctgaagattttgcagtctattactgtcagcagtataagaactttcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2333 - protein, 214 aa, Artificial Sequence; identical to SEQ ID NO: 2323
  Synthetic

SEQ ID NO: 2334 - DNA, 711 bp, Artificial Sequence; identical to SEQ ID NO: 2324
  Synthetic

SEQ ID NO: 2335 - protein, 214 aa, Artificial Sequence; identical to SEQ ID NO: 2323
  Synthetic

SEQ ID NO: 2336 - DNA, 711 bp, Artificial Sequence; identical to SEQ ID NO: 2324
  Synthetic

SEQ ID NO: 2337 - protein, 214 aa, Artificial Sequence; identical to SEQ ID NO: 2323
  Synthetic

SEQ ID NO: 2338 - DNA, 711 bp, Artificial Sequence; identical to SEQ ID NO: 2324
  Synthetic

SEQ ID NO: 2339 - protein, 214 aa, Artificial Sequence; identical to SEQ ID NO: 2323
  Synthetic

SEQ ID NO: 2340 - DNA, 711 bp, Artificial Sequence; identical to SEQ ID NO: 2324
  Synthetic

SEQ ID NO: 2341 - protein, 214 aa, Artificial Sequence; identical to SEQ ID NO: 2327
  Synthetic

SEQ ID NO: 2342 - DNA, 711 bp, Artificial Sequence; identical to SEQ ID NO: 2328
  Synthetic

SEQ ID NO: 2343 - protein, 214 aa, Artificial Sequence
  Synthetic
EIVMTQSPATLSVSPGERATLSCRASQSVSSNLAWYQQKSGQAPRLLIYGASIRATGIPARFSGSGSGTEFTLTISSLQSEDFAVYYCQQYKNFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2344 - DNA, 711 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttagcagcaacttagcctggtatcagcagaaatctggccaggctcccaggctcctcatctatggtgcatccatcagggccactggtatcccagccaggtttagcggcagtgggtctgggacagagttcacccttactatcagcagcctgcagtctgaagattttgcagtctattactgtcagcagtataagaactttcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2345 - protein, 214 aa, Artificial Sequence
  Synthetic
EIVMTQSPATLSVSPGERATLSCRASQSVSSNLAWYQQKPGQAPRLLIYGASIRATGIPARFSGSGSGTEFTLTISSLQSEDFAVYYCQQYKNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2346 - DNA, 711 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttagcagcaacttagcctggtatcagcagaaacctggccaggctcccaggctcctcatctatggtgcatccatcagggccactggtatcccagccaggtttagcggcagtgggtctgggacagagttcacccttactatcagcagcctgcagtctgaagattttgcagtctattactgtcagcagtataagaactggcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2347 - protein, 214 aa, Artificial Sequence
  Synthetic
EIVMTQSPATLSVSPGERATLSCRASQSVSSNLAWYQQKPGQAPRLLIYGASIRATGIPARFSGSGSGTEFTLTISSLQSEDFAVYYCQQYKNFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2348 - DNA, 711 bp, Artificial Sequence
  Synthetic
atggacatgagggtgcccgctcagctcctggggctcctgctgctgtggctgagaggtgcgcgctgtgaaatcgtgatgacgcagtctccagccaccctgtctgtgtctccaggggaaagagccaccctctcctgcagggccagtcagagtgttagcagcaacttagcctggtatcagcagaaacctggccaggctcccaggctcctcatctatggtgcatccatcagggccactggtatcccagccaggtttagcggcagtgggtctgggacagagttcacccttactatcagcagcctgcagtctgaagattttgcagtctattactgtcagcagtataagaactttcctctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2349 - protein, 214 aa, Artificial Sequence; identical to SEQ ID NO: 2345
  Synthetic

SEQ ID NO: 2350 - DNA, 711 bp, Artificial Sequence; identical to SEQ ID NO: 2346
  Synthetic

SEQ ID NO: 2351 - protein, 214 aa, Artificial Sequence; identical to SEQ ID NO: 2327
  Synthetic

SEQ ID NO: 2352 - DNA, 711 bp, Artificial Sequence; identical to SEQ ID NO: 2328
  Synthetic

SEQ ID NO: 2353 - protein, 214 aa, Artificial Sequence; identical to SEQ ID NO: 2347
  Synthetic

SEQ ID NO: 2354 - DNA, 711 bp, Artificial Sequence; identical to SEQ ID NO: 2348
  Synthetic

SEQ ID NO: 2355 - protein, 214 aa, Artificial Sequence; identical to SEQ ID NO: 2343
  Synthetic

SEQ ID NO: 2356 - DNA, 711 bp, Artificial Sequence; identical to SEQ ID NO: 2344
  Synthetic

SEQ ID NO: 2357 - protein, 214 aa, Artificial Sequence
  Synthetic
EIVMTQSPATLSVSPGERATLSCRASQSVSSNLAWYQQKSGQAPRLLIYGASIRATGIPARVSGSGSGTEFTFTISSLQSEDFAVYYCQQYKNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2358 - DNA, 711 bp, Artificial Sequence; identical to SEQ ID NO: 352
  Synthetic

SEQ ID NO: 2359 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTQFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2360 - protein, 166 aa, Artificial Sequence
  Synthetic
SPGQGTQSENSCTQFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2361 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTQFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2362 - protein, 166 aa, Artificial Sequence
  Synthetic
SPGQGTQSENSCTQFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2363 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTQFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2364 - protein, 166 aa, Artificial Sequence
  Synthetic
SPGQGTQSENSCTQFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2365 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFNGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2366 - protein, 166 aa, Artificial Sequence
  Synthetic
SPGQGTQSENSCTHFPGNLPNMLRDLRDAFSRVKTFFQMKDQLDNLLLKESLLEDFNGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2367 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFNGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2368 - protein, 166 aa, Artificial Sequence
  Synthetic
SPGQGTQSENSCTHFPGNLPNMLRDLRDAFSRVKTFFQMKDQLDNLLLKESLLEDFNGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2369 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFVPCENGGGSGGKSKAVEQVKNAFNKLQEKGIYKAMSEFDIFINYIEAYMTMKIRN

SEQ ID NO: 2370 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFVPCENGGGSGGKSKAVEQVKNAFNKLQEKGIYKAMSEFDIFINYIEAYMTMKIRN

SEQ ID NO: 2371 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFVPCENGGGSGGKSKAVEQVKNAFNKLQEKGIYDAMSEFDIFINYIEAYMTMKIRN

SEQ ID NO: 2372 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFVPCENGGGSGGKSKAVEQVKNAFNKLQEKGIYDAMSEFDIFINYIEAYMTMKIRN

SEQ ID NO: 2373 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKPHVNSLGENLKTLRLRLRRCHRFLPCENGGGSGGKSKAVEQVKNAFNKLQEKGIYKAMSEFDIFINYIEAYMTMKIRN

SEQ ID NO: 2374 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKPHVNSLGENLKTLRLRLRRCHRFLPCENGGGSGGKSKAVEQVKNAFNKLQEKGIYKAMSEFDIFINYIEAYMTMKIRN

SEQ ID NO: 2375 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCKNGGGSGGKSKAVEQVKNAFNKLQEKGIYKAMSEFDIFINYIEAYMTMKIRN

SEQ ID NO: 2376 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCKNGGGSGGKSKAVEQVKNAFNKLQEKGIYKAMSEFDIFINYIEAYMTMKIRN

SEQ ID NO: 2377 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDYKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2378 - protein, 166 aa, Artificial Sequence
  Synthetic
SPGQGTQSENSCTHFPGNLPNMLRDLRDAFSRVKTFFQMKDQLDNKLLKESLLEDYKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2379 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCDRFLPCENGGGSGGKSKAVEQVKNAFNKLQEKGIYKAMSEFDIFINYIEAYMTMKIRN

SEQ ID NO: 2380 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCDRFLPCENGGGSGGKSKAVEQVKNAFNKLQEKGIYKAMSEFDIFINYIEAYMTMKIRN

SEQ ID NO: 2381 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFNGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2382 - protein, 166 aa, Artificial Sequence
  Synthetic
SPGQGTQSENSCTHFPGNLPNMLRDLRDAFSRVKTFFQMKDQLDNKLLKESLLEDFNGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2383 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFVPCENGGGSGGKSKAVEQVKNAFNKLQEKGIYKAMSEFDIFINYIEAYMTMKIRN

SEQ ID NO: 2384 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFVPCENGGGSGGKSKAVEQVKNAFNKLQEKGIYKAMSEFDIFINYIEAYMTMKIRN

SEQ ID NO: 2385 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYQGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2386 - protein, 166 aa, Artificial Sequence
  Synthetic
SPGQGTQSENSCTHFPGNLPNMLRDLRDAFSRVKTFFQMKDQLDNKLLKESLLEDFKGYQGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2387 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCEDGGGSGGKSKAVEQVKNAFNKLQEKGIYKAMSEFDIFINYIEAYMTMKIRN

SEQ ID NO: 2388 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCEDGGGSGGKSKAVEQVKNAFNKLQEKGIYKAMSEFDIFINYIEAYMTMKIRN

SEQ ID NO: 2389 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCEALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2390 - protein, 166 aa, Artificial Sequence
  Synthetic
SPGQGTQSENSCTHFPGNLPNMLRDLRDAFSRVKTFFQMKDQLDNKLLKESLLEDFKGYLGCEALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2391 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCLALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2392 - protein, 166 aa, Artificial Sequence
  Synthetic
SPGQGTQSENSCTHFPGNLPNMLRDLRDAFSRVKTFFQMKDQLDNKLLKESLLEDFKGYLGCLALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2393 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIEFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2394 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIEFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2395 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIKFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2396 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIKFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2397 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENGGGSGGKSKAVEQVKNAFNKLQEKGIYKAMSEFDIFINYIEAYMTMKIRN

SEQ ID NO: 2398 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENGGGSGGKSKAVEQVKNAFNKLQEKGIYKAMSEFDIFINYIEAYMTMKIRN

SEQ ID NO: 2399 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHQFLPCENGGGSGGKSKAVEQVKNAFNKLQEKGIYKAMSEFDIFINYIEAYMTMKIRN

SEQ ID NO: 2400 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHQFLPCENGGGSGGKSKAVEQVKNAFNKLQEKGIYKAMSEFDIFINYIEAYMTMKIRN

SEQ ID NO: 2401 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENAGGSGGKSKAVEQVKNAFNKLQEKGIYKAMSEFDIFINYIEAYMTMKIRN

SEQ ID NO: 2402 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENAGGSGGKSKAVEQVKNAFNKLQEKGIYKAMSEFDIFINYIEAYMTMKIRN

SEQ ID NO: 2403 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENVGGSGGKSKAVEQVKNAFNKLQEKGIYKAMSEFDIFINYIEAYMTMKIRN

SEQ ID NO: 2404 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENVGGSGGKSKAVEQVKNAFNKLQEKGIYKAMSEFDIFINYIEAYMTMKIRN

SEQ ID NO: 2405 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSAGKSKAVEQVKNAFNKLQEKGIYKAMSEFDIFINYIEAYMTMKIRN

SEQ ID NO: 2406 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSAGKSKAVEQVKNAFNKLQEKGIYKAMSEFDIFINYIEAYMTMKIRN

SEQ ID NO: 2407 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNQLQEKGIYKAMSEFDIFINYIEAYMTMKIRN

SEQ ID NO: 2408 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNQLQEKGIYKAMSEFDIFINYIEAYMTMKIRN

SEQ ID NO: 2409 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMNIRN

SEQ ID NO: 2410 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMNIRN

SEQ ID NO: 2411 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYVTMKIRN

SEQ ID NO: 2412 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYVTMKIRN

SEQ ID NO: 2413 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRD

SEQ ID NO: 2414 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRD

SEQ ID NO: 2415 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYQGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2416 - protein, 166 aa, Artificial Sequence
  Synthetic
SPGQGTQSENSCTHFPGNLPNMLRDLRDAFSRVKTFFQMKDQLDNLLLKESLLEDFKGYQGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2417 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYQGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2418 - protein, 166 aa, Artificial Sequence
  Synthetic
SPGQGTQSENSCTHFPGNLPNMLRDLRDAFSRVKTFFQMKDQLDNLLLKESLLEDFKGYQGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2419 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNVLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2420 - protein, 166 aa, Artificial Sequence
  Synthetic
SPGQGTQSENSCTHFPGNLPNVLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2421 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNVLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2422 - protein, 166 aa, Artificial Sequence
  Synthetic
SPGQGTQSENSCTHFPGNLPNVLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2423 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNVLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2424 - protein, 166 aa, Artificial Sequence
  Synthetic
SPGQGTQSENSCTHFPGNLPNVLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2425 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNVLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2426 - protein, 166 aa, Artificial Sequence
  Synthetic
SPGQGTQSENSCTHFPGNLPNVLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2427 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCEDGGGSGGKSKAVEQVKNAFNKLQEKGIYKAMSEFDIFINYIEAYMTMKIRN

SEQ ID NO: 2428 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCEDGGGSGGKSKAVEQVKNAFNKLQEKGIYKAMSEFDIFINYIEAYMTMKIRN

SEQ ID NO: 2429 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCEDGGGSGGKSKAVEQVKNAFNKLQEKGIYDAMSEFDIFINYIEAYMTMKIRN

SEQ ID NO: 2430 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCEDGGGSGGKSKAVEQVKNAFNKLQEKGIYDAMSEFDIFINYIEAYMTMKIRN

SEQ ID NO: 2431 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKPHVNSLGENLKTLRLRLRRCHRFLPCENGGGSGGKSKAVEQVKNAFNKLQEKGIYKAMSEFDIFINYIEAYMTMKIRN

SEQ ID NO: 2432 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKPHVNSLGENLKTLRLRLRRCHRFLPCENGGGSGGKSKAVEQVKNAFNKLQEKGIYKAMSEFDIFINYIEAYMTMKIRN

SEQ ID NO: 2433 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCKNGGGSGGKSKAVEQVKNAFNKLQEKGIYKAMSEFDIFINYIEAYMTMKIRN

SEQ ID NO: 2434 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCKNGGGSGGKSKAVEQVKNAFNKLQEKGIYKAMSEFDIFINYIEAYMTMKIRN

SEQ ID NO: 2435 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDYKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2436 - protein, 166 aa, Artificial Sequence
  Synthetic
SPGQGTQSENSCTHFPGNLPNMLRDLRDAFSRVKTFFEMKDQLDNLLLKESLLEDYKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2437 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCDRFLPCENGGGSGGKSKAVEQVKNAFNKLQEKGIYKAMSEFDIFINYIEAYMTMKIRN

SEQ ID NO: 2438 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCDRFLPCENGGGSGGKSKAVEQVKNAFNKLQEKGIYKAMSEFDIFINYIEAYMTMKIRN

SEQ ID NO: 2439 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFNGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2440 - protein, 166 aa, Artificial Sequence
  Synthetic
SPGQGTQSENSCTHFPGNLPNMLRDLRDAFSRVKTFFEMKDQLDNLLLKESLLEDFNGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2441 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFVPCENGGGSGGKSKAVEQVKNAFNKLQEKGIYKAMSEFDIFINYIEAYMTMKIRN

SEQ ID NO: 2442 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFVPCENGGGSGGKSKAVEQVKNAFNKLQEKGIYKAMSEFDIFINYIEAYMTMKIRN

SEQ ID NO: 2443 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYQGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2444 - protein, 166 aa, Artificial Sequence
  Synthetic
SPGQGTQSENSCTHFPGNLPNMLRDLRDAFSRVKTFFEMKDQLDNLLLKESLLEDFKGYQGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2445 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCEDGGGSGGKSKAVEQVKNAFNKLQEKGIYKAMSEFDIFINYIEAYMTMKIRN

SEQ ID NO: 2446 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCEDGGGSGGKSKAVEQVKNAFNKLQEKGIYKAMSEFDIFINYIEAYMTMKIRN

SEQ ID NO: 2447 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCEALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2448 - protein, 166 aa, Artificial Sequence
  Synthetic
SPGQGTQSENSCTHFPGNLPNMLRDLRDAFSRVKTFFEMKDQLDNLLLKESLLEDFKGYLGCEALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2449 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCLALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2450 - protein, 166 aa, Artificial Sequence
  Synthetic
SPGQGTQSENSCTHFPGNLPNMLRDLRDAFSRVKTFFEMKDQLDNLLLKESLLEDFKGYLGCLALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2451 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIEFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2452 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIEFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2453 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIKFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2454 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIKFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2455 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHPFLPCENGGGSGGKSKAVEQVKNAFNKLQEKGIYKAMSEFDIFINYIEAYMTMKIRN

SEQ ID NO: 2456 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHPFLPCENGGGSGGKSKAVEQVKNAFNKLQEKGIYKAMSEFDIFINYIEAYMTMKIRN

SEQ ID NO: 2457 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHQFLPCENGGGSGGKSKAVEQVKNAFNKLQEKGIYKAMSEFDIFINYIEAYMTMKIRN

SEQ ID NO: 2458 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHQFLPCENGGGSGGKSKAVEQVKNAFNKLQEKGIYKAMSEFDIFINYIEAYMTMKIRN

SEQ ID NO: 2459 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSAGKSKAVEQVKNAFNKLQEKGIYKAMSEFDIFINYIEAYMTMKIRN

SEQ ID NO: 2460 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSAGKSKAVEQVKNAFNKLQEKGIYKAMSEFDIFINYIEAYMTMKIRN

SEQ ID NO: 2461 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENVGGSGGKSKAVEQVKNAFNKLQEKGIYKAMSEFDIFINYIEAYMTMKIRN

SEQ ID NO: 2462 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENVGGSGGKSKAVEQVKNAFNKLQEKGIYKAMSEFDIFINYIEAYMTMKIRN

SEQ ID NO: 2463 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENAGGSGGKSKAVEQVKNAFNKLQEKGIYKAMSEFDIFINYIEAYMTMKIRN

SEQ ID NO: 2464 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENAGGSGGKSKAVEQVKNAFNKLQEKGIYKAMSEFDIFINYIEAYMTMKIRN

SEQ ID NO: 2465 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNQLQEKGIYKAMSEFDIFINYIEAYMTMKIRN

SEQ ID NO: 2466 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNQLQEKGIYKAMSEFDIFINYIEAYMTMKIRN

SEQ ID NO: 2467 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMNIRN

SEQ ID NO: 2468 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMNIRN

SEQ ID NO: 2469 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYVTMKIRN

SEQ ID NO: 2470 - protein, 166 aa, Artificial Sequence
  Synthetic
SPGQGTQSENSCTHFPGNLPNMLRDLRDAFSRVKTFFEMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYVTMKIRN

SEQ ID NO: 2471 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCEALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2472 - protein, 166 aa, Artificial Sequence
  Synthetic
SPGQGTQSENSCTHFPGNLPNMLRDLRDAFSRVKTFFQMKDQLDNLLLKESLLEDFKGYLGCEALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2473 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCEALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2474 - protein, 166 aa, Artificial Sequence
  Synthetic
SPGQGTQSENSCTHFPGNLPNMLRDLRDAFSRVKTFFQMKDQLDNLLLKESLLEDFKGYLGCEALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2475 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCLALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2476 - protein, 166 aa, Artificial Sequence
  Synthetic
SPGQGTQSENSCTHFPGNLPNMLRDLRDAFSRVKTFFQMKDQLDNLLLKESLLEDFKGYLGCLALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2477 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCLALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2478 - protein, 166 aa, Artificial Sequence
  Synthetic
SPGQGTQSENSCTHFPGNLPNMLRDLRDAFSRVKTFFQMKDQLDNLLLKESLLEDFKGYLGCLALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2479 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIEFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2480 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIEFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2481 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIEFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2482 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIEFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2483 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIKFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2484 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIKFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2485 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIKFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2486 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIKFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2487 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHPFLPCENGGGSGGKSKAVEQVKNAFNKLQEKGIYKAMSEFDIFINYIEAYMTMKIRN

SEQ ID NO: 2488 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHPFLPCENGGGSGGKSKAVEQVKNAFNKLQEKGIYKAMSEFDIFINYIEAYMTMKIRN

SEQ ID NO: 2489 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHPFLPCENGGGSGGKSKAVEQVKNAFNKLQEKGIYDAMSEFDIFINYIEAYMTMKIRN

SEQ ID NO: 2490 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHPFLPCENGGGSGGKSKAVEQVKNAFNKLQEKGIYDAMSEFDIFINYIEAYMTMKIRN

SEQ ID NO: 2491 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHQFLPCENGGGSGGKSKAVEQVKNAFNKLQEKGIYKAMSEFDIFINYIEAYMTMKIRN

SEQ ID NO: 2492 - protein, 166 aa, Artificial Sequence
  Synthetic
SPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHQFLPCENGGGSGGKSKAVEQVKNAFNKLQEKGIYKAMSEFDIFINYIEAYMTMKIRN

SEQ ID NO: 2493 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNLLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYDAMSEFDIFINYIEAYMTMKIRN

SEQ ID NO: 2494 - protein, 166 aa, Artificial Sequence; identical to SEQ ID NO: 5
  Synthetic

SEQ ID NO: 2495 - protein, 622 aa, Artificial Sequence; identical to SEQ ID NO: 2475
  Synthetic

SEQ ID NO: 2496 - protein, 166 aa, Artificial Sequence; identical to SEQ ID NO: 2476
  Synthetic

SEQ ID NO: 2497 - protein, 622 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNGGGGSQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSRKEMTKNQVSLTCLVKGFYPSDIAVEWESNGQPENNYKTTPPVLKSDGSFFLYSKLTVDKSRWQQGNVFSCSVMHEALHNHYTQKSLSLSPG

SEQ ID NO: 2498 - protein, 622 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRNGGGGSQVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 2499 - protein, 622 aa, Artificial Sequence; identical to SEQ ID NO: 2009
  Synthetic

SEQ ID NO: 2500 - protein, 166 aa, Artificial Sequence
  Synthetic
SPGQGTQSENSCTHYPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2501 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMCDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGICKAMSEFDIFINYIEAYMTMKIRN

SEQ ID NO: 2502 - protein, 166 aa, Artificial Sequence
  Synthetic
SPGQGTQSENSCTHFPGNLPNMLRDLRDAFSRVKTFFQMCDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGICKAMSEFDIFINYIEAYMTMKIRN

SEQ ID NO: 2503 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQRPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2504 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQRPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2505 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSCMIQFYLEEVMPQAENQDPDIKAHVNSLGENLKTLRLRLRRCHRFLPCENGGGSGGKSKACEQVKNAFNKLQEKGIYKAMSEFDIFINYIEAYMTMKIRN

SEQ ID NO: 2506 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSCMIQFYLEEVMPQAENQDPDIKAHVNSLGENLKTLRLRLRRCHRFLPCENGGGSGGKSKACEQVKNAFNKLQEKGIYKAMSEFDIFINYIEAYMTMKIRN

SEQ ID NO: 2507 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAEVNSLGENLKTLRLRLRRCHRFLPCENGGGSGGKSKAVEQVKNAFNKLQEKGIYKAMSEFDIFINYIEAYMTMKIRN

SEQ ID NO: 2508 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAEVNSLGENLKTLRLRLRRCHRFLPCENGGGSGGKSKAVEQVKNAFNKLQEKGIYKAMSEFDIFINYIEAYMTMKIRN

SEQ ID NO: 2509 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAQVNSLGENLKTLRLRLRRCHRFLPCENGGGSGGKSKAVEQVKNAFNKLQEKGIYKAMSEFDIFINYIEAYMTMKIRN

SEQ ID NO: 2510 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAQVNSLGENLKTLRLRLRRCHRFLPCENGGGSGGKSKAVEQVKNAFNKLQEKGIYKAMSEFDIFINYIEAYMTMKIRN

SEQ ID NO: 2511 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLSESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2512 - protein, 166 aa, Artificial Sequence
  Synthetic
SPGQGTQSENSCTHFPGNLPNMLRDLRDAFSRVKTFFQMKDQLDNKLLSESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2513 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLTESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2514 - protein, 166 aa, Artificial Sequence
  Synthetic
SPGQGTQSENSCTHFPGNLPNMLRDLRDAFSRVKTFFQMKDQLDNKLLTESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2515 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFCGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTCKIRN

SEQ ID NO: 2516 - protein, 166 aa, Artificial Sequence
  Synthetic
SPGQGTQSENSCTHFPGNLPNMLRDLRDAFSRVKTFFQMKDQLDNKLLKESLLEDFCGYLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTCKIRN

SEQ ID NO: 2517 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENGGGSGGKSKAVEQVKNAFNKLQEKGIYKAMSEFDIFINYIEAYMTMKIRN

SEQ ID NO: 2518 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENGGGSGGKSKAVEQVKNAFNKLQEKGIYKAMSEFDIFINYIEAYMTMKIRN

SEQ ID NO: 2519 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVRPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2520 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVRPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2521 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVVPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2522 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVVPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2523 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPCAENQDPDIKAHVNSLGENLKTLRLRLRRCHRFLPCENGGGSGGKSKAVEQVKNAFNKLQEKGCYKAMSEFDIFINYIEAYMTMKIRN

SEQ ID NO: 2524 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPCAENQDPDIKAHVNSLGENLKTLRLRLRRCHRFLPCENGGGSGGKSKAVEQVKNAFNKLQEKGCYKAMSEFDIFINYIEAYMTMKIRN

SEQ ID NO: 2525 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPRAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2526 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPRAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2527 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNELGENLKTLRLRLRRCHRFLPCENGGGSGGKSKAVEQVKNAFNKLQEKGIYKAMSEFDIFINYIEAYMTMKIRN

SEQ ID NO: 2528 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNELGENLKTLRLRLRRCHRFLPCENGGGSGGKSKAVEQVKNAFNKLQEKGIYKAMSEFDIFINYIEAYMTMKIRN

SEQ ID NO: 2529 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNQLGENLKTLRLRLRRCHRFLPCENGGGSGGKSKAVEQVKNAFNKLQEKGIYKAMSEFDIFINYIEAYMTMKIRN

SEQ ID NO: 2530 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNQLGENLKTLRLRLRRCHRFLPCENGGGSGGKSKAVEQVKNAFNKLQEKGIYKAMSEFDIFINYIEAYMTMKIRN

SEQ ID NO: 2531 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKRLRLRLRRCHRFLPCENGGGSGGKSKAVEQVKNAFNKLQEKGIYKAMSEFDIFINYIEAYMTMKIRN

SEQ ID NO: 2532 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKRLRLRLRRCHRFLPCENGGGSGGKSKAVEQVKNAFNKLQEKGIYKAMSEFDIFINYIEAYMTMKIRN

SEQ ID NO: 2533 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGTLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2534 - protein, 166 aa, Artificial Sequence
  Synthetic
SPGQGTQSENSCTHFPGNLPNMLRDLRDAFSRVKTFFQMKDQLDNKLLKESLLEDFKGTLGCQALSEMIQFYLEEVMPQAENQDPDIKAHVNSLGENLKTLRLRLRRCHRFLPCENGGGSGGKSKAVEQVKNAFNKLQEKGIYKAMSEFDIFINYIEAYMTMKIRN

SEQ ID NO: 2535 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNMFNKLQEKGIYKAMSEFDIFINYIEAYMTMKIRN

SEQ ID NO: 2536 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHRFLPCENGGGSGGKSKAVEQVKNMFNKLQEKGIYKAMSEFDIFINYIEAYMTMKIRN

SEQ ID NO: 2537 - protein, 622 aa, Artificial Sequence; identical to SEQ ID NO: 2475
  Synthetic

SEQ ID NO: 2538 - skipped

SEQ ID NO: 2539 - protein, 622 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFCMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMCEFDIFINYIEAYMTMKIRN

SEQ ID NO: 2540 - protein, 166 aa, Artificial Sequence
  Synthetic
SPGQGTQSENSCTHFPGNLPNMLRDLRDAFSRVKTFFCMKDQLDNKLLKESLLEDFKGYLGCQALSEMIQFYLEEVMPQAENQDPDIKAHVNSLGENLKTLRLRLRRCHRFLPCENGGGSGGKSKAVEQVKNAFNKLQEKGIYKAMCEFDIFINYIEAYMTMKIRN

SEQ ID NO: 2541 - protein, 451 aa, Artificial Sequence
  Synthetic
QVQLVQSGAEVTKPGASVKVSCKASGYTFTRYDINWVRQATGQGLEWMGWMNPNSGNSGSVQKFRGRVTMTRDTSITTVYMELSSLRSDDTAVYYCARGGISSSWHWAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYDTTPPVLDSDGSFFLYSDLTVDKSRWQQGNVFSCSVMHEALHNHYTQDSLSLSPG

SEQ ID NO: 2542 - protein, 214 aa, Artificial Sequence; identical to SEQ ID NO: 2010
  Synthetic

SEQ ID NO: 2543 - protein, 215 aa, Artificial Sequence; identical to SEQ ID NO: 2253
  Synthetic

SEQ ID NO: 2544 - protein, 214 aa, Artificial Sequence
  Synthetic
DIQMTQSPSSLSASVGDRVTITCQASQDIRKHLNWYQQKPGKAPNLLIYDAANLETGVPSRFSGSGSGTAFTFTISSLQPEDIATYYCQHYANLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2545 - protein, 211 aa, Artificial Sequence
  Synthetic
SYELTQPPSVSVSPGQTASITCSGDKLGERNVSWYQLKPGQSPILVIYQDNKRPSGIPERFSGSKSGNTAILTISGTQAMDEADYYCQAWDRNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2546 - protein, 215 aa, Artificial Sequence
  Synthetic
EIVMTQSPAILSVSPGERATLSCRASQSVSSNLAWYQQKPGQAPRLLIYGASTRATGVPARFSGGGSGTDFTLTISSLQSEDFAVYYCQHFKTWPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2547 - protein, 215 aa, Artificial Sequence
  Synthetic
EIVMTQSPATLSVSPGERATLSCRASQSVNSNLAWYQQKPGRAPRLLIYGASTRATGIPARFSGSGSGTEFTLTISSLQSEDFAVYYCQQFYNWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2548 - protein, 214 aa, Artificial Sequence; identical to SEQ ID NO: 2357
  Synthetic

SEQ ID NO: 2549 - protein, 214 aa, Artificial Sequence
  Synthetic
DIQMTQSPSSVSASVGDRVTITCRASQGIRKWLAWYQQKPGRAPKLLIYAASRLQSGVPSRFSGSGSGTDFTLTISSLRPEDFATYYCLQAHGFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2550 - protein, 214 aa, Artificial Sequence
  Synthetic
DIQMTQSPSSLSASVGDRVTITCQASQDINNHLNWYQQKPGKAPKLLIYDVSNLETGVPSSFSGSGSGTDFTFTISSLQPEDIATYFCQQYDKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2551 - protein, 214 aa, Artificial Sequence
  Synthetic
DIQMTQSPSSLSASVGDRVTITCRASQSISSNLNWYQQKPGKAPKLLISAASNLQSGVPSRFSGSESGTDFTLTISSLQSEDFATYYCQQSDSLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2552 - protein, 214 aa, Artificial Sequence; identical to SEQ ID NO: 2010
  Synthetic

SEQ ID NO: 2553 - protein, 214 aa, Artificial Sequence
  Synthetic
DIQMTQSPSSLSASVGDRVTITCQASRDISKYLNWYQQKPGKAPKLQIYDASNLETGVPSRFSGSGSGTDFTFTISSLQPEDIATYYCQHYDNIPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2554 - protein, 214 aa, Artificial Sequence
  Synthetic
DIQMTQSPSSLSASVGDRVTITCQASQDISKHLNWYQQKPGKAPKLLIYDTSNLETGVPSRFSGSGSGTDFTFTISSLQPEDIATYNCQQYDKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2555 - protein, 214 aa, Artificial Sequence
  Synthetic
DTQMTQSPSSLSASEGDRVTITCQASQDIFNDLNWYQEKPGKAPKLLIYHASNLETGVPSRFSGSGSGTDYTFTISSLQPEDIATYYCQQYGNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2556 - protein, 214 aa, Artificial Sequence
  Synthetic
DIQMTQFPSSVSASVGDRVTITCRASQGISRWLAWYQQKQGKAPKLLIYMVSSLQSGVPSRFSGSGSGTDFTLTISSLQPEDFATYYCQQSHNFPITFGQGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2557 - protein, 214 aa, Artificial Sequence; identical to SEQ ID NO: 2544
  Synthetic

SEQ ID NO: 2558 - protein, 215 aa, Artificial Sequence; identical to SEQ ID NO: 2546
  Synthetic

SEQ ID NO: 2559 - protein, 214 aa, Artificial Sequence; identical to SEQ ID NO: 2549
  Synthetic

SEQ ID NO: 2560 - protein, 214 aa, Artificial Sequence; identical to SEQ ID NO: 2550
  Synthetic

SEQ ID NO: 2561 - protein, 214 aa, Artificial Sequence; identical to SEQ ID NO: 2553
  Synthetic

SEQ ID NO: 2562 - protein, 214 aa, Artificial Sequence; identical to SEQ ID NO: 2555
  Synthetic

SEQ ID NO: 2563 - protein, 214 aa, Artificial Sequence; identical to SEQ ID NO: 2556
  Synthetic

SEQ ID NO: 2564 - protein, 214 aa, Artificial Sequence
  Synthetic
DIQMTQSPSSLSASVGDRVTITCQASQDINNHLNWYQQKPGKAPKLLIYDVSNLETGVPSRFSGSGSGTDFTFTISSLQPEDIATYYCQQYDKLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2565 - protein, 214 aa, Artificial Sequence; identical to SEQ ID NO: 2564
  Synthetic

SEQ ID NO: 2566 - protein, 214 aa, Artificial Sequence
  Synthetic
DIQMTQSPSSVSASVGDRVTITCRASQGISRWLAWYQQKQGKAPKLLIYMVSSLQSGVPSRFSGSGSGTDFTLTISSLQPEDFATYYCQQSHNFPITFGQGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2567 - protein, 214 aa, Artificial Sequence; identical to SEQ ID NO: 2566
  Synthetic

SEQ ID NO: 2568 - protein, 214 aa, Artificial Sequence; identical to SEQ ID NO: 2566
  Synthetic

SEQ ID NO: 2569 - protein, 214 aa, Artificial Sequence
  Synthetic
DIQMTQSPSSVSASVGDRVTITCRASQGISRWLAWYQQKPGKAPKLLIYMVSSLQSGVPSRFSGSGSGTDFTLTISSLQPEDFATYYCQQSHNFPITFGQGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2570 - protein, 214 aa, Artificial Sequence; identical to SEQ ID NO: 2566
  Synthetic

SEQ ID NO: 2571 - protein, 214 aa, Artificial Sequence
  Synthetic
DTQMTQSPSSLSASVGDRVTITCQASQDIFNDLNWYQEKPGKAPKLLIYHASNLETGVPSRFSGSGSGTDFTFTISSLQPEDIATYYCQQYGNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2572 - protein, 214 aa, Artificial Sequence
  Synthetic
DTQMTQSPSSLSASVGDRVTITCQASQDIFNDLNWYQQKPGKAPKLLIYHASNLETGVPSRFSGSGSGTDYTFTISSLQPEDIATYYCQQYGNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2573 - protein, 214 aa, Artificial Sequence
  Synthetic
DTQMTQSPSSLSASVGDRVTITCQASQDIFNDLNWYQEKPGKAPKLLIYHASNLETGVPSRFSGSGSGTDYTFTISSLQPEDIATYYCQQYGNLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2574 - protein, 214 aa, Artificial Sequence
  Synthetic
DIQMTQSPSSLSASVGDRVTITCQASRDISKYLNWYQQKPGKAPKLLIYDASNLETGVPSRFSGSGSGTDFTFTISSLQPEDFATYYCQHYDNIPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2575 - protein, 214 aa, Artificial Sequence
  Synthetic
DIQMTQSPSSLSASVGDRVTITCQASRDISKYLNWYQQKPGKAPKLLIYDASNLETGVPSRFSGSGSGTDFTFTISSLQPEDIATYYCQHYDNIPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2576 - protein, 214 aa, Artificial Sequence; identical to SEQ ID NO: 2574
  Synthetic

SEQ ID NO: 2577 - protein, 214 aa, Artificial Sequence; identical to SEQ ID NO: 2575
  Synthetic

SEQ ID NO: 2578 - protein, 214 aa, Artificial Sequence; identical to SEQ ID NO: 2574
  Synthetic

SEQ ID NO: 2579 - protein, 214 aa, Artificial Sequence; identical to SEQ ID NO: 2574
  Synthetic

SEQ ID NO: 2580 - protein, 214 aa, Artificial Sequence; identical to SEQ ID NO: 2574
  Synthetic

SEQ ID NO: 2581 - protein, 214 aa, Artificial Sequence; identical to SEQ ID NO: 2575
  Synthetic

SEQ ID NO: 2582 - protein, 214 aa, Artificial Sequence; identical to SEQ ID NO: 2549
  Synthetic

SEQ ID NO: 2583 - protein, 214 aa, Artificial Sequence; identical to SEQ ID NO: 2549
  Synthetic

SEQ ID NO: 2584 - protein, 214 aa, Artificial Sequence; identical to SEQ ID NO: 2549
  Synthetic

SEQ ID NO: 2585 - protein, 214 aa, Artificial Sequence
  Synthetic
DIQMTQSPSSLSASVGDRVTITCQASQDIRKHLNWYQQKPGKAPKLLIYDAANLETGVPSRFSGSGSGTDFTFTISSLQPEDFATYYCQHYANLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2586 - protein, 214 aa, Artificial Sequence; identical to SEQ ID NO: 2544
  Synthetic

SEQ ID NO: 2587 - protein, 214 aa, Artificial Sequence; identical to SEQ ID NO: 2585
  Synthetic

SEQ ID NO: 2588 - protein, 214 aa, Artificial Sequence; identical to SEQ ID NO: 2544
  Synthetic

SEQ ID NO: 2589 - protein, 214 aa, Artificial Sequence; identical to SEQ ID NO: 2585
  Synthetic

SEQ ID NO: 2590 - protein, 214 aa, Artificial Sequence; identical to SEQ ID NO: 2585
  Synthetic

SEQ ID NO: 2591 - protein, 214 aa, Artificial Sequence; identical to SEQ ID NO: 2585
  Synthetic

SEQ ID NO: 2592 - protein, 214 aa, Artificial Sequence
  Synthetic
DIQMTQSPSSLSASVGDRVTITCQASQDIRKHLNWYQQKPGKAPKLLIYDAANLETGVPSRFSGSGSGTDFTLTISSLQPEDFATYYCQHYANLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2593 - protein, 214 aa, Artificial Sequence; identical to SEQ ID NO: 2544
  Synthetic

SEQ ID NO: 2594 - protein, 214 aa, Artificial Sequence; identical to SEQ ID NO: 2544
  Synthetic

SEQ ID NO: 2595 - protein, 214 aa, Artificial Sequence; identical to SEQ ID NO: 2585
  Synthetic

SEQ ID NO: 2596 - protein, 211 aa, Artificial Sequence
  Synthetic
SYELTQPPSVSVSPGQTASITCSGDKLGERQVSWYQQKPGQSPVLVIYQDNKRPSGIPERFSGSKSGNTATLTISGTQAMDEADYYCQAWDRNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2597 - protein, 211 aa, Artificial Sequence
  Synthetic
SYELTQPPSVSVSPGQTASITCSGDKLGERQVSWYQLKPGQSPVLVIYQDNKRPSGIPERFSGSKSGNTATLTISGTQAMDEADYYCQAWDRNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2598 - protein, 211 aa, Artificial Sequence
  Synthetic
SYELTQPPSVSVSPGQTASITCSGDKLGERNVGWYQQKPGQSPVLVIYQDNKRPSGIPERFSGSKSGNTATLTISGTQAMDEADYYCQAWDRNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2599 - protein, 211 aa, Artificial Sequence
  Synthetic
SYELTQPPSVSVSPGQTASITCSGDKLGERNVAWYQQKPGQSPVLVIYQDNKRPSGIPERFSGSKSGNTATLTISGTQAMDEADYYCQAWDRNVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 2600 - protein, 211 aa, Artificial Sequence; identical to SEQ ID NO: 2597
  Synthetic

SEQ ID NO: 2601 - protein, 215 aa, Artificial Sequence
  Synthetic
EIVMTQSPATLSVSPGERATLSCRASQSVSSNLAWYQQKPGQAPRLLIYGASTRATGIPARFSGSGSGTDFTLTISSLQPEDFAVYYCQHFKTWPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2602 - protein, 215 aa, Artificial Sequence
  Synthetic
EIVMTQSPATLSVSPGERATLSCRASQSVSSNLAWYQQKPGQAPRLLIYGASTRATGIPARFSGSGSGTDFTLTISSLQSEDFAVYYCQHFKTYPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2603 - protein, 215 aa, Artificial Sequence
  Synthetic
EIVMTQSPATLSVSPGERATLSCRASQSVSSNLAWYQQKPGQAPRLLIYGASTRATGIPARFSGSGSGTDFTLTISSLQSEDFAVYYCQHFKTFPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2604 - protein, 215 aa, Artificial Sequence
  Synthetic
EIVMTQSPATLSVSPGERATLSCRASQSVSSNLAWYQQKPGQAPRLLIYGASTRATGIPARFSGSGSGTDFTLTISSLQSEDFAVYYCQHFKTHPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2605 - protein, 215 aa, Artificial Sequence
  Synthetic
EIVMTQSPATLSVSPGERATLSCRASQSVSSNLAWYQQKPGQAPRLLIYGASTRATGIPARFSGSGSGTDFTLTISSLQPEDFAVYYCQHFKTYPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 2606 - DNA, 714 bp, Artificial Sequence; identical to SEQ ID NO: 304
  Synthetic

SEQ ID NO: 2607 - DNA, 711 bp, Artificial Sequence; identical to SEQ ID NO: 512
  Synthetic

SEQ ID NO: 2608 - DNA, 693 bp, Artificial Sequence; identical to SEQ ID NO: 464
  Synthetic

SEQ ID NO: 2609 - DNA, 714 bp, Artificial Sequence; identical to SEQ ID NO: 320
  Synthetic

SEQ ID NO: 2610 - DNA, 714 bp, Artificial Sequence; identical to SEQ ID NO: 336
  Synthetic

SEQ ID NO: 2611 - DNA, 711 bp, Artificial Sequence; identical to SEQ ID NO: 352
  Synthetic

SEQ ID NO: 2612 - DNA, 711 bp, Artificial Sequence; identical to SEQ ID NO: 368
  Synthetic

SEQ ID NO: 2613 - DNA, 711 bp, Artificial Sequence; identical to SEQ ID NO: 384
  Synthetic

SEQ ID NO: 2614 - DNA, 711 bp, Artificial Sequence; identical to SEQ ID NO: 496
  Synthetic

SEQ ID NO: 2615 - DNA, 711 bp, Artificial Sequence; identical to SEQ ID NO: 480
  Synthetic

SEQ ID NO: 2616 - DNA, 711 bp, Artificial Sequence; identical to SEQ ID NO: 400
  Synthetic

SEQ ID NO: 2617 - DNA, 711 bp, Artificial Sequence; identical to SEQ ID NO: 416
  Synthetic

SEQ ID NO: 2618 - DNA, 711 bp, Artificial Sequence; identical to SEQ ID NO: 432
  Synthetic

SEQ ID NO: 2619 - DNA, 711 bp, Artificial Sequence; identical to SEQ ID NO: 448
  Synthetic

SEQ ID NO: 2620 - DNA, 711 bp, Artificial Sequence; identical to SEQ ID NO: 512
  Synthetic

SEQ ID NO: 2621 - DNA, 714 bp, Artificial Sequence; identical to SEQ ID NO: 320
  Synthetic

SEQ ID NO: 2622 - DNA, 711 bp, Artificial Sequence; identical to SEQ ID NO: 368
  Synthetic

SEQ ID NO: 2623 - DNA, 711 bp, Artificial Sequence; identical to SEQ ID NO: 384
  Synthetic

SEQ ID NO: 2624 - DNA, 711 bp, Artificial Sequence; identical to SEQ ID NO: 400
  Synthetic

SEQ ID NO: 2625 - DNA, 711 bp, Artificial Sequence; identical to SEQ ID NO: 432
  Synthetic

SEQ ID NO: 2626 - DNA, 711 bp, Artificial Sequence; identical to SEQ ID NO: 448
  Synthetic

SEQ ID NO: 2627 - DNA, 711 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcaggacattaacaaccatttaaattggtatcagcagaaaccagggaaagcccctaagctcctgatctacgatgtatccaatttggaaacaggggtcccatcacgtttcagtggaagtggaagcgggacagattttactttcaccatcagcagcctgcagcctgaagatatcgcaacatattattgtcaacagtatgataaactcccgctcacttttggcggagggaccaaggtggagatcaagcgcacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2628 - DNA, 711 bp, Artificial Sequence; identical to SEQ ID NO: 2627
  Synthetic

SEQ ID NO: 2629 - DNA, 711 bp, Artificial Sequence
  Synthetic
atggacatgagggtgcccgctcagctcctggggctcctgctgctgtggctgagaggtgcgcgctgtgacatccagatgacccagtctccatcttccgtgtctgcatctgtaggagacagagtcaccatcacttgtcgggcgagtcaggggattagcaggtggttagcctggtatcagcagaaacaagggaaagcccctaagctcctgatctatatggtatccagtttgcaaagtggggtcccatcaaggttcagtggcagtggatctgggacagatttcactctcaccatcagcagcctgcagcctgaagattttgcaacttactattgtcagcagtctcacaatttcccgatcaccttcggccaagggacacgactggacattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2630 - DNA, 711 bp, Artificial Sequence; identical to SEQ ID NO: 2629
  Synthetic

SEQ ID NO: 2631 - DNA, 711 bp, Artificial Sequence; identical to SEQ ID NO: 2629
  Synthetic

SEQ ID NO: 2632 - DNA, 711 bp, Artificial Sequence
  Synthetic
atggacatgagggtgcccgctcagctcctggggctcctgctgctgtggctgagaggtgcgcgctgtgacatccagatgacccagtctccatcttccgtgtctgcatctgtaggagacagagtcaccatcacttgtcgggcgagtcaggggattagcaggtggttagcctggtatcagcagaaacctgggaaagcccctaagctcctgatctatatggtatccagtttgcaaagtggggtcccatcaaggttcagtggcagtggatctgggacagatttcactctcaccatcagcagcctgcagcctgaagattttgcaacttactattgtcagcagtctcacaatttcccgatcaccttcggccaagggacacgactggacattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2633 - DNA, 711 bp, Artificial Sequence; identical to SEQ ID NO: 2629
  Synthetic

SEQ ID NO: 2634 - DNA, 711 bp, Artificial Sequence
  Synthetic
atggacatgagggtgcccgctcagctcctggggctcctgctgctgtggctgagaggtgcgcgctgtgacacccagatgacccagtctccatcctccctgtctgcatctgttggagacagagtcaccatcacttgccaggcgagtcaggacattttcaacgatttaaattggtatcaggagaaaccagggaaagcccctaagctcctgatctaccatgcatccaatttggaaacaggggtcccatcaaggttcagtggaagtggatctgggacagattttactttcaccatcagcagcctgcagcctgaagatattgctacatattactgtcaacaatatggaaatctcccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2635 - DNA, 711 bp, Artificial Sequence
  Synthetic
atggacatgagggtgcccgctcagctcctggggctcctgctgctgtggctgagaggtgcgcgctgtgacacccagatgacccagtctccatcctccctgtctgcatctgttggagacagagtcaccatcacttgccaggcgagtcaggacattttcaacgatttaaattggtatcagcaaaaaccagggaaagcccctaagctcctgatctaccatgcatccaatttggaaacaggggtcccatcaaggttcagtggaagtggatctgggacagattatactttcaccatcagcagcctgcagcctgaagatattgctacatattactgtcaacaatatggaaatctcccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2636 - DNA, 711 bp, Artificial Sequence
  Synthetic
atggacatgagggtgcccgctcagctcctggggctcctgctgctgtggctgagaggtgcgcgctgtgacacccagatgacccagtctccatcctccctgtctgcatctgttggagacagagtcaccatcacttgccaggcgagtcaggacattttcaacgatttaaattggtatcaggagaaaccagggaaagcccctaagctcctgatctaccatgcatccaatttggaaacaggggtcccatcaaggttcagtggaagtggatctgggacagattatactttcaccatcagcagcctgcagcctgaagatattgctacatattactgtcaacaatatggaaatctcccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2637 - DNA, 711 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcgggacattagcaagtatttaaattggtatcaacagaaaccagggaaagcccccaaactccttatctacgatgcatccaatttggaaacaggggtcccatcaaggttcagtggaagtggatctgggacagattttactttcaccatcagcagcctgcagcctgaagattttgcaacatattactgtcaacactatgataatatcccgatcacctttggccaggggacaagactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2638 - DNA, 711 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcgggacattagcaagtatttaaattggtatcaacagaaaccagggaaagcccccaaactccttatctacgatgcatccaatttggaaacaggggtcccatcaaggttcagtggaagtggatctgggacagattttactttcaccatcagcagcctgcagcctgaagatattgcaacatattactgtcaacactatgataatatcccgatcacctttggccaggggacaagactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2639 - DNA, 711 bp, Artificial Sequence; identical to SEQ ID NO: 2637
  Synthetic

SEQ ID NO: 2640 - DNA, 711 bp, Artificial Sequence; identical to SEQ ID NO: 2638
  Synthetic

SEQ ID NO: 2641 - DNA, 711 bp, Artificial Sequence; identical to SEQ ID NO: 2637
  Synthetic

SEQ ID NO: 2642 - DNA, 711 bp, Artificial Sequence; identical to SEQ ID NO: 2637
  Synthetic

SEQ ID NO: 2643 - DNA, 711 bp, Artificial Sequence; identical to SEQ ID NO: 2637
  Synthetic

SEQ ID NO: 2644 - DNA, 711 bp, Artificial Sequence; identical to SEQ ID NO: 2638
  Synthetic

SEQ ID NO: 2645 - DNA, 711 bp, Artificial Sequence; identical to SEQ ID NO: 368
  Synthetic

SEQ ID NO: 2646 - DNA, 711 bp, Artificial Sequence; identical to SEQ ID NO: 368
  Synthetic

SEQ ID NO: 2647 - DNA, 711 bp, Artificial Sequence; identical to SEQ ID NO: 368
  Synthetic

SEQ ID NO: 2648 - DNA, 711 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcaggacattaggaaacatttaaattggtatcagcagaaaccagggaaagcccctaaactcctgatctacgatgcagccaatttggaaacaggggtcccatcaaggttcagtggaagtggttctgggacagattttactttcaccatcagcagcctgcagcctgaagattttgcaacatattactgtcaacactatgctaatctcccgatcaccttcggccaagggacacgactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2649 - DNA, 711 bp, Artificial Sequence; identical to SEQ ID NO: 512
  Synthetic

SEQ ID NO: 2650 - DNA, 711 bp, Artificial Sequence; identical to SEQ ID NO: 2648
  Synthetic

SEQ ID NO: 2651 - DNA, 711 bp, Artificial Sequence; identical to SEQ ID NO: 512
  Synthetic

SEQ ID NO: 2652 - DNA, 711 bp, Artificial Sequence; identical to SEQ ID NO: 2648
  Synthetic

SEQ ID NO: 2653 - DNA, 711 bp, Artificial Sequence; identical to SEQ ID NO: 2648
  Synthetic

SEQ ID NO: 2654 - DNA, 711 bp, Artificial Sequence; identical to SEQ ID NO: 2648
  Synthetic

SEQ ID NO: 2655 - DNA, 711 bp, Artificial Sequence
  Synthetic
atggacatgagggtgcccgctcagctcctggggctcctgctgctgtggctgagaggtgcgcgctgtgacatccagatgacccagtctccatcctccctgtctgcatctgtaggagacagagtcaccatcacttgccaggcgagtcaggacattaggaaacatttaaattggtatcagcagaaaccagggaaagcccctaaactcctgatctacgatgcagccaatttggaaacaggggtcccatcaaggttcagtggaagtggttctgggacagattttactcttaccatcagcagcctgcagcctgaagattttgcaacatattactgtcaacactatgctaatctcccgatcaccttcggccaagggacacgactggagattaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2656 - DNA, 711 bp, Artificial Sequence; identical to SEQ ID NO: 512
  Synthetic

SEQ ID NO: 2657 - DNA, 711 bp, Artificial Sequence; identical to SEQ ID NO: 512
  Synthetic

SEQ ID NO: 2658 - DNA, 711 bp, Artificial Sequence; identical to SEQ ID NO: 2648
  Synthetic

SEQ ID NO: 2659 - DNA, 693 bp, Artificial Sequence
  Synthetic
atggcctgggctctgctgctcctcaccctcctcactcagggcacagggtcctgggcctcctatgagctgactcagccaccctcagtgtccgtgtccccaggacagacagccagcatcacctgctctggagataaattgggggagagacaagttagctggtatcagcaaaagccaggccagtcccctgttctggtcatctatcaagataacaagcggccctcagggatccctgagcgattctctggctccaagtctgggaacacagccactctgaccatcagcgggacccaggcaatggatgaggctgactattactgtcaggcgtgggacagaaatgtggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 2660 - DNA, 693 bp, Artificial Sequence
  Synthetic
atggcctgggctctgctgctcctcaccctcctcactcagggcacagggtcctgggcctcctatgagctgactcagccaccctcagtgtccgtgtccccaggacagacagccagcatcacctgctctggagataaattgggggagagacaagttagctggtatcagttgaagccaggccagtcccctgttctggtcatctatcaagataacaagcggccctcagggatccctgagcgattctctggctccaagtctgggaacacagccactctgaccatcagcgggacccaggcaatggatgaggctgactattactgtcaggcgtgggacagaaatgtggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 2661 - DNA, 693 bp, Artificial Sequence
  Synthetic
atggcctgggctctgctgctcctcaccctcctcactcagggcacagggtcctgggcctcctatgagctgactcagccaccctcagtgtccgtgtccccaggacagacagccagcatcacctgctctggagataaattgggggagagaaatgttggttggtatcagcaaaagccaggccagtcccctgttctggtcatctatcaagataacaagcggccctcagggatccctgagcgattctctggctccaagtctgggaacacagccactctgaccatcagcgggacccaggcaatggatgaggctgactattactgtcaggcgtgggacagaaatgtggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 2662 - DNA, 693 bp, Artificial Sequence
  Synthetic
atggcctgggctctgctgctcctcaccctcctcactcagggcacagggtcctgggcctcctatgagctgactcagccaccctcagtgtccgtgtccccaggacagacagccagcatcacctgctctggagataaattgggggagagaaatgttgcttggtatcagcaaaagccaggccagtcccctgttctggtcatctatcaagataacaagcggccctcagggatccctgagcgattctctggctccaagtctgggaacacagccactctgaccatcagcgggacccaggcaatggatgaggctgactattactgtcaggcgtgggacagaaatgtggtattcggcggagggaccaagctgaccgtcctaggtcagcccaaggctgcaccctcggtcactctgttcccgccctcctctgaggagcttcaagccaacaaggccacactggtgtgtctcatcagtgacttctacccgggagccgtgacagtggcctggaaggcagatagcagccccgtcaaggcgggagtggaaaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatag

SEQ ID NO: 2663 - DNA, 693 bp, Artificial Sequence; identical to SEQ ID NO: 2660
  Synthetic

SEQ ID NO: 2664 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccactctgtctgtgtctccaggggaaagagccaccctctcctgcagggccagtcagagtgttagcagcaacttagcctggtaccagcagaaacctggccaggctcccaggctcctcatctatggtgcatccaccagggccacgggtattccagccaggttcagtggctctgggtctgggacagacttcactctcaccatcagcagcctgcagcctgaagattttgcagtttattactgtcagcacttcaagacctggcctccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2665 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccactctgtctgtgtctccaggggaaagagccaccctctcctgcagggccagtcagagtgttagcagcaacttagcctggtaccagcagaaacctggccaggctcccaggctcctcatctatggtgcatccaccagggccacgggtattccagccaggttcagtggctctgggtctgggacagacttcactctcaccatcagcagcctgcagtctgaagattttgcagtttattactgtcagcacttcaagacctatcctccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2666 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccactctgtctgtgtctccaggggaaagagccaccctctcctgcagggccagtcagagtgttagcagcaacttagcctggtaccagcagaaacctggccaggctcccaggctcctcatctatggtgcatccaccagggccacgggtattccagccaggttcagtggctctgggtctgggacagacttcactctcaccatcagcagcctgcagtctgaagattttgcagtttattactgtcagcacttcaagacctttcctccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2667 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccactctgtctgtgtctccaggggaaagagccaccctctcctgcagggccagtcagagtgttagcagcaacttagcctggtaccagcagaaacctggccaggctcccaggctcctcatctatggtgcatccaccagggccacgggtattccagccaggttcagtggctctgggtctgggacagacttcactctcaccatcagcagcctgcagtctgaagattttgcagtttattactgtcagcacttcaagacccatcctccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2668 - DNA, 714 bp, Artificial Sequence
  Synthetic
atggacatgagggtgcccgctcagctcctggggctcctgctgctgtggctgagaggtgcgcgctgtgaaatcgtgatgacgcagtctccagccactctgtctgtgtctccaggggaaagagccaccctctcctgcagggccagtcagagtgttagcagcaacttagcctggtaccagcagaaacctggccaggctcccaggctcctcatctatggtgcatccaccagggccacgggtattccagccaggttcagtggctctgggtctgggacagacttcactctcaccatcagcagcctgcagcctgaagattttgcagtttattactgtcagcacttcaagacctatcctccgctcactttcggcggagggaccaaggtggagatcaaacgaacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttag

SEQ ID NO: 2669 - protein, 14 aa, Artificial Sequence
  Synthetic
TSGSGTYYADSVKG

SEQ ID NO: 2670 - protein, 10 aa, Artificial Sequence
  Synthetic
VAGSNFLFDY

SEQ ID NO: 2671 - protein, 13 aa, Artificial Sequence
  Synthetic
GGYTSSWRWYFDL

SEQ ID NO: 2672 - protein, 14 aa, Artificial Sequence
  Synthetic
GGYTSSWSRWYFDL

SEQ ID NO: 2673 - protein, 8 aa, Artificial Sequence
  Synthetic
DYGDSFDY

SEQ ID NO: 2674 - protein, 22 aa, Artificial Sequence
  Synthetic
MDMRVPAQLLGLLLLWLRGARC

SEQ ID NO: 2675 - protein, 23 aa, Artificial Sequence
  Synthetic
MAWALLLLTLLTQGTGSWASYEL

SEQ ID NO: 2676 - protein, 6 aa, Artificial Sequence
  Synthetic
GGGSGG

SEQ ID NO: 2677 - protein, 4 aa, Artificial Sequence
  Synthetic
GGGG

SEQ ID NO: 2678 - protein, 4 aa, Artificial Sequence
  Synthetic
RPTG

SEQ ID NO: 2679 - protein, 5 aa, Artificial Sequence
  Synthetic
SGSSG

SEQ ID NO: 2680 - protein, 5 aa, Artificial Sequence
  Synthetic
GATGK

SEQ ID NO: 2681 - protein, 4 aa, Artificial Sequence
  Synthetic
VPAR

SEQ ID NO: 2682 - protein, 5 aa, Artificial Sequence
  Synthetic
SSSSG

SEQ ID NO: 2683 - protein, 5 aa, Artificial Sequence
  Synthetic
SSSPG

SEQ ID NO: 2684 - protein, 4 aa, Artificial Sequence
  Synthetic
SSGG

SEQ ID NO: 2685 - protein, 4 aa, Artificial Sequence
  Synthetic
GKTG

SEQ ID NO: 2686 - protein, 5 aa, Artificial Sequence
  Synthetic
GSGTG

SEQ ID NO: 2687 - protein, 4 aa, Artificial Sequence
  Synthetic
GGAG

SEQ ID NO: 2688 - protein, 5 aa, Artificial Sequence
  Synthetic
GSSSG

SEQ ID NO: 2689 - protein, 5 aa, Artificial Sequence
  Synthetic
RPKAT

SEQ ID NO: 2690 - protein, 4 aa, Artificial Sequence
  Synthetic
SGSG

SEQ ID NO: 2691 - protein, 5 aa, Artificial Sequence
  Synthetic
SSSGG

SEQ ID NO: 2692 - protein, 4 aa, Artificial Sequence
  Synthetic
SGGG

SEQ ID NO: 2693 - protein, 4 aa, Artificial Sequence
  Synthetic
NAGG

SEQ ID NO: 2694 - protein, 5 aa, Artificial Sequence
  Synthetic
KPGST

SEQ ID NO: 2695 - protein, 4 aa, Artificial Sequence
  Synthetic
RPSG

SEQ ID NO: 2696 - protein, 5 aa, Artificial Sequence
  Synthetic
SGSGG

SEQ ID NO: 2697 - protein, 5 aa, Artificial Sequence
  Synthetic
KGGKG

SEQ ID NO: 2698 - protein, 4 aa, Artificial Sequence
  Synthetic
GGSS

SEQ ID NO: 2699 - protein, 4 aa, Artificial Sequence
  Synthetic
KPTG

SEQ ID NO: 2700 - protein, 5 aa, Artificial Sequence
  Synthetic
GGGSS

SEQ ID NO: 2701 - protein, 4 aa, Artificial Sequence
  Synthetic
GSSS

SEQ ID NO: 2702 - protein, 5 aa, Artificial Sequence
  Synthetic
GKKAT

SEQ ID NO: 2703 - protein, 4 aa, Artificial Sequence
  Synthetic
RSSG

SEQ ID NO: 2704 - protein, 5 aa, Artificial Sequence
  Synthetic
AKVGS

SEQ ID NO: 2705 - protein, 4 aa, Artificial Sequence
  Synthetic
GGGS

SEQ ID NO: 2706 - protein, 4 aa, Artificial Sequence
  Synthetic
GGGP

SEQ ID NO: 2707 - protein, 4 aa, Artificial Sequence
  Synthetic
GGGQ

SEQ ID NO: 2708 - protein, 5 aa, Artificial Sequence
  Synthetic
GGGGG

SEQ ID NO: 2709 - protein, 8 aa, Artificial Sequence
  Synthetic
GGGSGGGS

SEQ ID NO: 2710 - protein, 10 aa, Artificial Sequence
  Synthetic
GGGGSGGGGS

SEQ ID NO: 2711 - protein, 12 aa, Artificial Sequence
  Synthetic
GGGSGGGSGGGS

SEQ ID NO: 2712 - protein, 15 aa, Artificial Sequence
  Synthetic
GGGGSGGGGSGGGGS

SEQ ID NO: 2713 - protein, 16 aa, Artificial Sequence
  Synthetic
GGGSGGGSGGGSGGGS

SEQ ID NO: 2714 - protein, 20 aa, Artificial Sequence
  Synthetic
GGGGSGGGGSGGGGSGGGGS

SEQ ID NO: 2715 - protein, 20 aa, Artificial Sequence
  Synthetic
GGGSGGGSGGGSGGGSGGGS

SEQ ID NO: 2716 - protein, 25 aa, Artificial Sequence
  Synthetic
GGGGSGGGGSGGGGSGGGGSGGGGS

SEQ ID NO: 2717 - protein, 24 aa, Artificial Sequence
  Synthetic
GGGSGGGSGGGSGGGSGGGSGGGS

SEQ ID NO: 2718 - protein, 30 aa, Artificial Sequence
  Synthetic
GGGGSGGGGSGGGGSGGGGSGGGGSGGGGS

SEQ ID NO: 2719 - protein, 23 aa, Artificial Sequence
  Synthetic
GSGSATGGSGSSASSGSGSATHL

SEQ ID NO: 2720 - protein, 23 aa, Artificial Sequence
  Synthetic
GSGSATGGSGSVASSGSGSATHL

SEQ ID NO: 2721 - protein, 23 aa, Artificial Sequence
  Synthetic
GSGSATGGSGSSASSGSGSATHL

SEQ ID NO: 2722 - protein, 23 aa, Artificial Sequence
  Synthetic
GSGSATGGSGSGASSGSGSATGS

SEQ ID NO: 2723 - protein, 5 aa, Artificial Sequence
  Synthetic
  MISC_FEATURE (4)..(4): Xaa is M or I
GYYXH

SEQ ID NO: 2724 - protein, 21 aa, Artificial Sequence
  Synthetic
EPSKCGGGGAASRLQSDKTHC

SEQ ID NO: 2725 - protein, 5 aa, Artificial Sequence
  Synthetic
GGGGS

SEQ ID NO: 2726 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRN

SEQ ID NO: 2727 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRN

SEQ ID NO: 2728 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEKSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRN

SEQ ID NO: 2729 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRN

SEQ ID NO: 2730 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRN

SEQ ID NO: 2731 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRN

SEQ ID NO: 2732 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEKSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRN

SEQ ID NO: 2733 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENAGGSGGKSKAVEQVKNAFNKLQEKGIYKAMSEFDIFINYIEAYMTMKIRN

SEQ ID NO: 2734 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENAGGSGGKSKAVEQVKNAFNKLQEKGIYKAMSEFDIFINYIEAYMTMKIRN

SEQ ID NO: 2735 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHPFLPCENAGGSGGKSKAVEQVKNAFNKLQEKGIYKAMSEFDIFINYIEAYMTMKIRN

SEQ ID NO: 2736 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRN

SEQ ID NO: 2737 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENAGGSGGKSKAVEQVKNAFNKLQEKGIYKAMSEFDIFINYIEAYMTMKIRN

SEQ ID NO: 2738 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRN

SEQ ID NO: 2739 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHPFLPCENAGGSGGKSKAVEQVKNAFNKLQEKGIYKAMSEFDIFINYIEAYMTMKIRN

SEQ ID NO: 2740 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENAGGSGGKSKAVEQVKNAFNKLQEKGIYKAMSEFDIFINYIEAYMTMKIRN

SEQ ID NO: 2741 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENAGGSGGKSKAVEQVKNAFNKLQEKGIYKAMSEFDIFINYIEAYMTMKIRN

SEQ ID NO: 2742 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRN

SEQ ID NO: 2743 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRN

SEQ ID NO: 2744 - protein, 628 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRNGGGGSGGGGSQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2745 - protein, 630 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRNGGGGSGGGGSQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2746 - protein, 628 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRNGGGGSGGGGSQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2747 - protein, 630 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRNGGGGSGGGGSQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2748 - protein, 628 aa, Artificial Sequence
  Synthetic
SPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRNGGGGSGGGGSQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2749 - protein, 630 aa, Artificial Sequence
  Synthetic
SPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRNGGGGSGGGGSQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2750 - protein, 628 aa, Artificial Sequence
  Synthetic
SPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRNGGGGSGGGGSQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2751 - protein, 630 aa, Artificial Sequence
  Synthetic
SPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRNGGGGSGGGGSQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2752 - protein, 628 aa, Artificial Sequence
  Synthetic
SPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRNGGGGSGGGGSQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2753 - protein, 630 aa, Artificial Sequence
  Synthetic
SPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRNGGGGSGGGGSQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2754 - protein, 628 aa, Artificial Sequence
  Synthetic
SPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRNGGGGSGGGGSQVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2755 - protein, 630 aa, Artificial Sequence
  Synthetic
SPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRNGGGGSGGGGSQVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2756 - protein, 626 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRNGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2757 - protein, 626 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRNGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2758 - protein, 626 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRNGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2759 - protein, 626 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRNGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2760 - protein, 626 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRNGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2761 - protein, 626 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRNGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2762 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENGGGSGGKSKAVEQVKNAFNKLQEKGIYKAMSEFDIFINYIEAYMTMKIRN

SEQ ID NO: 2763 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRN

SEQ ID NO: 2764 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENGGGSGGKSKAVEQVKNAFNKLQEKGIYKAMSEFDIFINYIEAYMTMKIRN

SEQ ID NO: 2765 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCEQGGGSGGKSKAVEQVKNAFNKLQEKGIYKAMSEFDIFINYIEAYMTMKIRN

SEQ ID NO: 2766 - protein, 622 aa, Artificial Sequence
  Synthetic
QVQLVQSGAEVKKPGASVKVSCKASGYTFTSYDINWVRQATGQGLEWMGRMNPKSGNAGYVQNFRGRVTMTRDTSISTAYMELSSLRSEDTAVYYCARGGRTSIWSFVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENGGGSGGKSKAVEQVKNAFNKLQEKGIYKAMSEFDIFINYIEAYMTMKIRN

SEQ ID NO: 2767 - protein, 628 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRNGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2768 - protein, 628 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRNGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2769 - protein, 628 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRNGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2770 - protein, 628 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRNGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2771 - protein, 628 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRNGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2772 - protein, 628 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRNGGGGDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2773 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENAGGSGGKSKAVEQVKNAFNKLQEKGIYKAMSEFDIFINYIEAYMTMKIRN

SEQ ID NO: 2774 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENGGGSGGKSKAVEQVKNAFNKLQEKGIYKAMSEFDIFINYIEAYMTMKIRN

SEQ ID NO: 2775 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENGGGSGGKSKAVEQVKNAFNKLQEKGIYKAMSEFDIFINYIEAYMTMKIRN

SEQ ID NO: 2776 - protein, 624 aa, Artificial Sequence
  Synthetic
QVQLVQSGAEVKKPGASVKVSCKASGYTFTSYDINWVRQATGQGLEWMGWMNPNRGNTGYVKKFQGRVTMTRDTSISTAYMELSSLRSEDTAVYYCARRRAVYRSSWEWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPCEEQYGSTYRCVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGGGGGSSPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENGGGSGGKSKAVEQVKNAFNKLQEKGIYKAMSEFDIFINYIEAYMTMKIRN

SEQ ID NO: 2777 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRN

SEQ ID NO: 2778 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRN

SEQ ID NO: 2779 - protein, 166 aa, Artificial Sequence
  Synthetic
SPGQGTQSENSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENAGGSGGKSKAVEQVKNAFNKLQEKGIYKAMSEFDIFINYIEAYMTMKIRN

SEQ ID NO: 2780 - protein, 166 aa, Artificial Sequence; identical to SEQ ID NO: 2398
  Synthetic

SEQ ID NO: 2781 - protein, 166 aa, Artificial Sequence
  Synthetic
SPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRN

SEQ ID NO: 2782 - protein, 166 aa, Artificial Sequence
  Synthetic
SPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRN

SEQ ID NO: 2783 - protein, 166 aa, Artificial Sequence
  Synthetic
SPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHPFLPCENAGGSGGKSKAVEQVKNAFNKLQEKGIYKAMSEFDIFINYIEAYMTMKIRN

SEQ ID NO: 2784 - protein, 166 aa, Artificial Sequence
  Synthetic
SPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENGGGSGGKSKAVEQVKNAFNKLQEKGIYKAMSEFDIFINYIEAYMTMKIRN

SEQ ID NO: 2785 - protein, 166 aa, Artificial Sequence
  Synthetic
SPGQGTQSEISCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENAGGSGGKSKAVEQVKNAFNKLQEKGIYKAMSEFDIFINYIEAYMTMKIRN

SEQ ID NO: 2786 - protein, 166 aa, Artificial Sequence
  Synthetic
SPGQGTQSEKSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENAGGSGGKSKAVEQVKNAFNKLQEKGIYKAMSEFDIFINYIEAYMTMKIRN

SEQ ID NO: 2787 - protein, 166 aa, Artificial Sequence
  Synthetic
SPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENVGGSGGKSKAVEQVKNAFNKLQEKGIYKAMSEFDIFINYIEAYMTMKIRN

SEQ ID NO: 2788 - protein, 166 aa, Artificial Sequence; identical to SEQ ID NO: 2787
  Synthetic

SEQ ID NO: 2789 - protein, 166 aa, Artificial Sequence
  Synthetic
SPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCEQGGGSGGKSKAVEQVKNAFNKLQEKGIYKAMSEFDIFINYIEAYMTMKIRN

SEQ ID NO: 2790 - protein, 166 aa, Artificial Sequence
  Synthetic
SPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRERLRRCHRFLPCENGGGSGGKSKAVEQVKNAFNKLQEKGIYKAMSEFDIFINYIEAYMTMKIRN

SEQ ID NO: 2791 - protein, 166 aa, Artificial Sequence
  Synthetic
SPGQGTQSEQSCTHFPGNLPNMLRDLRDAFSRVKTFFQMKDQLDNKLLKESLLEDFKGYLGCQALSEMIQFYLEEVMPQAENQDPDIKAHVNSLGENLKTLRLRLRRCHPFLPCENAGGSGGKSKAVEQVKNAFNKLQEKGIYKAMSEFDIFINYIEAYMTMKIRN

---

What is claimed is:

1. A human interleukin-10 (IL-10) mutein comprising one or more mutations selected from R27L, K34D, D41G, L46K, Q38E, Q38R, Q38D, K138L, K138D, H14Q, F15Y, M22V, K49T, K49S, F56Y, Y59T, L60Q, Q63E, Q63L, Q70E, Q70K, M77R, M77V, Q79R, Q79C, D84R, A89P, H90E, H90Q, S93E, S93Q, T100R, L103E, H109D, R110P, R110Q, L112V, E115K, A127M, K130Q, I136C, Y137C, M154V, M156C, K157N, of SEQ ID NO: 2.

2. A human interleukin-10 (IL-10) mutein comprising the amino acid sequence of any one of SEQ ID NOs: 3-10 or SEQ ID NOS: 2138, 2140, 2142, 2144, 2146, 2148, 2150, 2152, 2154, 2156, 2160, 2162, 2164, 2166, 2168, 2170, 2172, 2174, 2176, 2178, 2180, 2182, 2360, 2362, 2364, 2368, 2370, 2372, 2374, 2376, 2378, 2380, 2382, 2384, 2386, 2388, 2390, 2392, 2394, 2396, 2398, 2400, 2402, 2404, 2406, 2408, 2410, 2412, 2414, 2416, 2418, 2420, 2422, 2424, 2426, 2428, 2430, 2432, 2434, 2436, 2438, 2440, 2442, 2444, 2446, 2448, 2450, 2452, 2454, 2456, 2458, 2460, 2462, 2464, 2466, 2468, 2470, 2472, 2474, 2476, 2478, 2480, 2482, 2484, 2486, 2488, 2490, 2492, 2494, 2496, 2500, 2502, 2504, 2506, 2508, 2510, 2512, 2514, 2516, 2518, 2520, 2522, 2524, 2526, 2528, 2530, 2532, 2534, 2536, 2540 or 2777-2791.

3. An isolated nucleic acid molecule comprising a nucleotide sequence that encodes the IL-10 mutein of claim 2.

4. A composition comprising the IL-10 mutein of claim 2 and a pharmaceutically acceptable carrier.

5. A method of treating inflammatory bowel disease, ulcerative colitis, Crohn's disease, irritable bowel syndrome, rheumatoid arthritis, psoriasis, psoriatic arthritis, or cytokine release syndrome (CRS) in a subject in need thereof comprising administering to the subject the composition of claim 4.

6. The IL-10 mutein of claim 1, further comprising one or more mutations selected from I87A, K57N, E67C, N116D, N160D, and an insertion of the amino acid sequence GGGSGG (SEQ ID NO: 2676) between helix D and helix E.

* * * * *